US012752002B2

(12) United States Patent
King et al.

(10) Patent No.: US 12,752,002 B2
(45) Date of Patent: Oct. 6, 2026

(54) POLYPEPTIDES, COMPOSITIONS, AND THEIR USE TO TREAT OR LIMIT DEVELOPMENT OF AN INFECTION

(71) Applicant: University of Washington, Seattle, WA (US)

(72) Inventors: Neil P. King, Seattle, WA (US); David Veesler, Seattle, WA (US); Carl Walkey, Seattle, WA (US); Alexandra C. Walls, Seattle, WA (US); Jing Yang Wang, Seattle, WA (US)

(73) Assignee: UNIVERSITY OF WASHINGTON, Seattle, WA (US)

( * ) Notice: Subject to any disclaimer, the term of this patent is extended or adjusted under 35 U.S.C. 154(b) by 654 days.

(21) Appl. No.: 17/760,174

(22) PCT Filed: Feb. 12, 2021

(86) PCT No.: PCT/US2021/017799

§ 371 (c)(1),
(2) Date: Nov. 17, 2022

(87) PCT Pub. No.: WO2021/163438

PCT Pub. Date: Aug. 19, 2021

(65) Prior Publication Data

US 2024/0277831 A1 Aug. 22, 2024

Related U.S. Application Data

(60) Provisional application No. 63/064,235, filed on Aug. 11, 2020, provisional application No. 63/046,159, filed on Jun. 30, 2020, provisional application No. 62/977,036, filed on Feb. 14, 2020.

(51) Int. Cl.

| | |
|---|---|
| ***A61K 39/215*** | (2006.01) |
| ***A61K 39/00*** | (2006.01) |
| ***A61P 31/14*** | (2006.01) |
| ***C07K 14/005*** | (2006.01) |

(52) U.S. Cl.

CPC ............ *A61K 39/215* (2013.01); *A61P 31/14* (2018.01); *C07K 14/005* (2013.01); *A61K 2039/55555* (2013.01); *A61K 2039/575* (2013.01); *C12N 2770/20022* (2013.01); *C12N 2770/20034* (2013.01)

(58) Field of Classification Search

CPC ........ A61K 39/215; A61K 2039/55555; A61K 2039/575; A61K 39/12; A61P 31/14; C07K 14/005; C12N 2770/20022; C12N 2770/20034

See application file for complete search history.

(56) References Cited

U.S. PATENT DOCUMENTS

| | | | |
|---|---|---|---|
| 6,262,202 | B1 | 7/2001 | Walzer et al. |
| 6,303,767 | B1 | 10/2001 | Betlach et al. |
| 6,929,933 | B1 | 8/2005 | Revuelta Doval et al. |
| 8,563,002 | B2 | 10/2013 | Baudoux et al. |
| 8,586,056 | B2 | 11/2013 | Phogat et al. |
| 8,969,521 | B2 | 3/2015 | Baker et al. |
| 9,441,019 | B2 | 9/2016 | Nabel et al. |
| 9,487,593 | B2 | 11/2016 | Powell et al. |
| 9,630,994 | B2 | 4/2017 | Baker et al. |
| 9,738,689 | B2 | 8/2017 | Kwong et al. |
| 9,856,313 | B2 | 1/2018 | Zheng et al. |
| 9,913,894 | B2 | 3/2018 | Tous et al. |
| 9,950,058 | B2 | 4/2018 | Che et al. |
| 10,017,543 | B2 | 7/2018 | Kwong et al. |
| 10,022,437 | B2 | 7/2018 | Pushko et al. |
| 10,040,828 | B2 | 8/2018 | Weiner et al. |
| 10,351,603 | B2 | 7/2019 | Baker et al. |
| 11,771,755 | B2 | 10/2023 | King et al. |
| 2004/0005672 | A1 | 1/2004 | Santi et al. |
| 2004/0214276 | A1 | 10/2004 | Khosla et al. |
| 2005/0123763 | A1 | 6/2005 | Hiltzik et al. |
| 2005/0137387 | A1 | 6/2005 | Mullins et al. |
| 2006/0075522 | A1 | 4/2006 | Cleveland et al. |
| 2007/0020624 | A1 | 1/2007 | Rubenfield et al. |
| 2007/0105193 | A1 | 5/2007 | Vilalta et al. |
| 2007/0218547 | A1 | 9/2007 | Yeates et al. |

(Continued)

FOREIGN PATENT DOCUMENTS

| | | | |
|---|---|---|---|
| CN | 104436202 | A | 7/2017 |
| CN | 107157933 | B | 9/2017 |
| EP | 1010760 | A1 | 6/2000 |
| WO | 2005049641 | A2 | 6/2005 |
| WO | 2005123763 | A1 | 12/2005 |
| WO | 2006033679 | A2 | 3/2006 |
| WO | 2009016639 | A2 | 2/2009 |
| WO | 2010019725 | A2 | 2/2010 |
| WO | 2010035009 | A1 | 4/2010 |

(Continued)

OTHER PUBLICATIONS

Dondelinger M, Filée P, Sauvage E, Quinting B, Muyldermans S, Galleni M, Vandevenne MS. Understanding the Significance and Implications of Antibody Numbering and Antigen-Binding Surface/Residue Definition. Front Immunol. Oct. 16, 2018;9:2278. (Year: 2018).*

(Continued)

*Primary Examiner* — Rachel B Gill
(74) *Attorney, Agent, or Firm* — MCDONNELL BOEHNEN HULBERT & BERGHOFF LLP

(57) ABSTRACT

The present disclosure relates to polypeptides comprising an amino acid sequence that is at least 95% identical to the amino acid sequence selected from the group consisting of SEQ ID NOS: 1-84, 138-146, and 167-184, nanoparticles comprising the polypeptides, compositions comprising the nanoparticles, and their use of the nanoparticles or compositions to treat or limit development of an infection.

19 Claims, 12 Drawing Sheets

Specification includes a Sequence Listing.

(56) References Cited

U.S. PATENT DOCUMENTS

| | | | | |
|---|---|---|---|---|
| 2011/0020311 | A1 | 1/2011 | Boucher | |
| 2011/0020378 | A1 | 1/2011 | Burkhard | |
| 2011/0085939 | A1 | 4/2011 | Salemme et al. | |
| 2011/0200560 | A1 | 8/2011 | Zhang | |
| 2012/0015000 | A1 | 1/2012 | Lanar et al. | |
| 2012/0059156 | A1 | 3/2012 | Salemme et al. | |
| 2012/0210459 | A1 | 8/2012 | Kerfeld et al. | |
| 2012/0213817 | A1 | 8/2012 | Haynes | |
| 2013/0122032 | A1 | 5/2013 | Smith et al. | |
| 2013/0315955 | A1 | 11/2013 | Holtz et al. | |
| 2014/0248314 | A1 | 9/2014 | Swanson et al. | |
| 2014/0302079 | A1 | 10/2014 | Nabel et al. | |
| 2015/0110825 | A1 | 4/2015 | Sasisekharan et al. | |
| 2015/0356240 | A1* | 12/2015 | Baker | G01N 33/6845 703/11 |
| 2016/0046675 | A1 | 2/2016 | Kwong et al. | |
| 2016/0122392 | A1* | 5/2016 | Baker | C07K 14/00 536/23.1 |
| 2016/0159864 | A1 | 6/2016 | Carfi et al. | |
| 2016/0324958 | A1 | 11/2016 | Burkhard et al. | |
| 2017/0182151 | A1 | 6/2017 | Che et al. | |
| 2017/0189519 | A1 | 7/2017 | Impagliazzo et al. | |
| 2017/0202948 | A1 | 7/2017 | Smith et al. | |
| 2017/0298101 | A1 | 10/2017 | Kwong et al. | |
| 2017/0326228 | A1 | 11/2017 | Cheminay et al. | |
| 2018/0021258 | A1 | 1/2018 | Graham et al. | |
| 2018/0194808 | A1 | 7/2018 | Langedijk et al. | |
| 2018/0200360 | A1 | 7/2018 | Langedijk et al. | |
| 2018/0237476 | A1 | 8/2018 | Swanson et al. | |
| 2018/0256704 | A1 | 9/2018 | Nicosia et al. | |
| 2019/0030156 | A1 | 1/2019 | Galarza et al. | |
| 2019/0330279 | A1 | 10/2019 | Kwong et al. | |
| 2019/0389915 | A1 | 12/2019 | Kwong et al. | |
| 2020/0392187 | A1* | 12/2020 | King | C07K 14/005 |

FOREIGN PATENT DOCUMENTS

| | | | |
|---|---|---|---|
| WO | 2011019585 | A1 | 2/2011 |
| WO | 2013044203 | A3 | 3/2013 |
| WO | 2013056122 | A1 | 4/2013 |
| WO | 2014124301 | A1 | 8/2014 |
| WO | 2015048149 | A1 | 4/2015 |
| WO | 2015177312 | A1 | 11/2015 |
| WO | 2016138525 | A1 | 9/2016 |
| WO | 2016160166 | A1 | 10/2016 |
| WO | 2016203052 | A1 | 12/2016 |
| WO | 2017005844 | A1 | 1/2017 |
| WO | 2017040387 | A2 | 3/2017 |
| WO | 2017046801 | A1 | 3/2017 |
| WO | 2017066484 | A2 | 4/2017 |
| WO | 2017070626 | A2 | 4/2017 |
| WO | 2017075125 | A1 | 5/2017 |
| WO | 2017172890 | A1 | 10/2017 |
| WO | 2017174568 | A1 | 10/2017 |
| WO | 2017207477 | A1 | 12/2017 |
| WO | 2017207480 | A1 | 12/2017 |
| WO | 2018005558 | A1 | 1/2018 |
| WO | 2018047856 | A1 | 3/2018 |
| WO | 2018187325 | A1 | 4/2018 |
| WO | 2018109220 | A2 | 6/2018 |
| WO | 2018148647 | A2 | 8/2018 |
| WO | 2018175560 | A1 | 9/2018 |
| WO | 2019169210 | A1 | 9/2019 |
| WO | 2019194393 | A1 | 10/2019 |

OTHER PUBLICATIONS

Collis AV, Brouwer AP, Martin AC. Analysis of the antigen combining site: correlations between length and sequence composition of the hypervariable loops and the nature of the antigen. J Mol Biol. Jan. 10, 2003;325(2):337-54. (Year: 2003).*

Tsuchiya Y, Mizuguchi K. The diversity of H3 loops determines the antigen-binding tendencies of antibody CDR loops. Protein Sci. Apr. 2016;25(4):815-25. Epub Jan. 20, 2016 (Year: 2016).*

Sirin S, Apgar JR, Bennett EM, Keating AE. AB-Bind: Antibody binding mutational database for computational affinity predictions. Protein Sci. Feb. 2016;25(2):393-409. Epub Nov. 6, 2015. (Year: 2015).*

Sela-Culang I, Kunik V, Ofran Y. The structural basis of antibody-antigen recognition. Front Immunol. Oct. 8, 2013;4:302. (Year: 2013).*

Chen Z, Wang J, Bao L, Guo L, Zhang W, Xue Y, Zhou H, Xiao Y, Wang J, Wu F, Deng Y, Qin C, Jin Q. Human monoclonal antibodies targeting the haemagglutinin glycoprotein can neutralize H7N9 influenza virus. Nat Commun. Mar. 30, 2015;6:6714. (Year : 2015).*

Kussie PH, Parhami-Seren B, Wysocki LJ, Margolies MN. A single engineered amino acid substitution changes antibody fine specificity. J Immunol. Jan. 1, 1994;152(1):146-52. (Year: 1994).*

Winkler K, Kramer A, Küttner G, Seifert M, Scholz C, Wessner H, Schneider-Mergener J, Höhne W. Changing the antigen binding specificity by single point mutations of an anti-p24 (HIV-1) antibody. J Immunol. Oct. 15, 2000;165(8):4505-14. (Year: 2000).*

Bowie JU, Reidhaar-Olson JF, Lim WA, Sauer RT. Deciphering the message in protein sequences: tolerance to amino acid substitutions. Science. Mar. 16, 1990;247(4948):1306-10. (Year: 1990).*

Walls AC, Fiala B, Schäfer A, Wrenn S, Pham MN, Murphy M, Tse LV, Shehata L, et. al. Elicitation of potent neutralizing antibody responses by designed protein nanoparticle vaccines for SARS-CoV-2. bioRxiv [Preprint]. Aug. 12, 2020:2020.08.11.247395. Update in: Cell. Nov. 25, 2020;183(5):1367-1382.e17. (Year: 2020).*

Rutten L, Swart M, Koornneef A, Bouchier P, Blokland S, Sadi A, Juraszek J, Vijayan A, Schmit-Tillemans S, Verspuij J, Choi Y, Daal CE, et al. Impact of SARS-CoV-2 spike stability and RBD exposure on antigenicity and immunogenicity. Sci Rep. Mar. 8, 2024;14(1):5735. (Year: 2024).*

Sung HD, Kim N, Lee Y, Lee EJ. Protein-Based Nanoparticle Vaccines for SARS-CoV-2. Int J Mol Sci. Dec. 14, 2021;22(24):13445. (Year: 2021).*

Dowling QM, Park YJ, Gerstenmaier N, Yang EC, Wargacki A, Hsia Y, Fries CN, Ravichandran R, Walkey C, Burrell A, Veesler D, Baker D, King NP. Hierarchical design of pseudosymmetric protein nanoparticles. bioRxiv [Preprint]. Jun. 17, 2023: 2023.06.16.545393. Update in: Nature. Feb. 2025;638(8050):553-561. (Year: 2023).*

Bale JB, Gonen S, Liu Y, Sheffler W, Ellis D, Thomas C, Cascio D, Yeates TO, Gonen T, King NP, Baker D. Accurate design of megadalton-scale two-component icosahedral protein complexes. Science. Jul. 22, 2016;353(6297):389-94. (Year: 2016).*

Pati R, Shevtsov M, Sonawane A. Nanoparticle Vaccines Against Infectious Diseases. Front Immunol. Oct. 4, 2018;9:2224. (Year: 2018).*

Grigorieff, "FREALIGN: high-resolution refinement of single particle structures," Journal of Structural Biology, vol. 157, No. 1, pp. 117-125, 2007.

Grigoryan et al. Computational design of virus-like protein assemblies on carbon nanotube surfaces. Science 332, 1071-1076 (2011).

Grueninger et al. Designed protein-protein association. Science 319, 206-209 (2008).

Guttman et al., "Analysis of overlapped and noisy hydrogen/deuterium exchange mass spectra" J. Am. Soc. Mass Spectrom. 24: 1906-12 (2013).

Han et al. DNA gridiron nanostructures based on four-arm junctions. Science 339, 1412-1415 (2013).

Harbury, et al., "High-resolution protein design with backbone freedom," Science, vol. 282, No. 5393, pp. 1462-1467, 1998.

Henderson et al., "Controlling the SARS-CoV-2 spike glycoprotein conformation" Nat. Struct. Mol. Biol. 27(10): 925-933 (2020).

Hessa et al., "Molecular code for transmembrane-helix recognition by the Sec61 translocon" Nature 450(7172): 1026-30 (2007).

Hessa et al., "Recognition of transmembrane helices by the endoplasmic reticulum translocon" Nature 433(7024): 377-81 (2005).

Hoffman et al., "SARS-CoV-2 Cell Entry Depends on ACE2 and TMPRSS2 and is Blocked by a Clinically Proven Protease Inhibitor" Cell 181: 271-280.e278 (2020).

(56) References Cited

OTHER PUBLICATIONS

Hou et al., "SARS-CoV-2 Reverse Genetics Reveals a Varaible Infection Gradient in the Respiratory Tract" Cell 182, 429-446.e414 (2020).
Howorka, Rationally engineering natural protein assemblies in nanobiotechnology. Curr. Opin. Biotechnol. 22, 485-491 (2011).
Hsia et al., Design of a hyperstable 60-subunit protein icosahedron, Nature 535:136-39 (2016).
Hsieh et al., "Structure-based design of prefusion-stabilized SARS-CoV-2 spikes" Science 369(6510):1501-1505 (2020).
Huang et al., A de novo designed protein protein interface. Protein Sci. 16, 2770-2774 (2007).
Huang et al., "The coming of age of de novo protein design" Nature 537(7620): 320-7 (2016).
Huo et al., "Neutralisation of SARS-CoV-2 by destruction of the prefusion Spike" Cell Host & Microbe 28(3): 445-454 (2020).
Hura et al., "Robust, high-throughput solution structural analysis by small angle X-ray scattering (SAXS)" Nat Methods 6(8): 556-66 (2010).
Hurley, et al., "Membrane Budding and Scission by the ESCRT Machinery: It's All in the Neck," Nature Reviews Molecular Cell Biology, vol. 11, No. 8, pp. 556-566, 2010.
Icosavax Launches COVID-19 Vaccine Program with Preclinical Data and $16.5 Million in New Funding. Oct. 30, 2020. Press release <<https://ir.icosavax.com/news-releases/news-release-details/icosavax-launches-covid-19-vaccine-program-preclinical-data-and>.
Irvine et al., "Shaping humoral immunity to vaccines through antigen-displaying nanoparticles" Curr Opin Immunol 65: 1-6 (2020).
Ishikawa, et al., "STING is an endoplasmic reticulum adaptor that facilitates innate immune signalling," Nature, vol. 455, No. 7213, pp. 674-678, 2008.
Jacak, et al., "Computational Protein Design with Explicit Consideration of Surface Hydrophobic Patches," Proteins: Structure, Function, and Bioinformatics, vol. 80, No. 3, pp. 825-838, 2012.
Jackel, et al., "Consensus Protein Design Without Phylogenetic Bias," Journal of Molecular Biology, vol. 399, No. 4, pp. 541-546, 2010.
Jackel et al., Protein design by directed evolution. Annu. Rev. Biophys. 37, 153-173 (2008).
Janin et al., Protein-protein interaction and quaternary structure. Q. Rev. Biophys. 41, 133-180 (2008).
Jayaraj et al., The Open Veterinary Science Journal, 3, 28-34 (2009).
Jha et al., Computational design of a PAK1 binding protein. J. Mol. Biol. 400, 257-270 (2010).
Jones et al., "A Method for Producing Protein Nanoparticles with Applications in Vaccines," PLoS One 11(3): e0138761 (2016).
Julien, et al., "Crystal structure of a soluble cleaved HIV-1 envelope trimer," Science, vol. 342, No. 6165, pp. 1477-1483, 2013.
Juraszek et al., "Stabilizing the closed SARS-CoV-2 spike trimer." Biorxiv, doi: 10.1101/2020.07.10.197814 (2020).
Kaba et al., "Self-assembling protein nanoparticles with built-in flagellin domains increases protective efficacy of a Plasmodium falciparum based vaccine" Vaccine 36(6): 906-914 (2018).
Kabsch, Xds. Acta Crystallogr. D Biol. Crystallogr. 66, 125-132 (2010).
Kanekiyo et al., "Self-assembling influenza nanoparticle vaccines elicit broadly neutralizing H1N1 antibodies." Nature. Jul. 4, 2013;499(7456):102-6. doi: 10.1038/nature12202. Epub May 22, 2013. PMID: 23698367.
Kanekiyo et al., "Rational Design of an Epstein-Barr Virus Vaccine Targeting the Receptor-Binding Site" Cell 162: 1090-1100 (2015).
Kaneyiko et al., "Mosaic nanoparticle display of diverse influenza virus hemagglutinins elicits broad B cell responses" Nat. Immunol. 20(3): 362-72 (2019).
Kaneyiko et al., "New Vaccine Design and Delivery Technologies" J. Infect Dis. 219: S88-S96 (2019).
Kaneyiko et al., "Next-Generation Influenza Vaccines" Cold Spring Harb Perspect Med 11(8): a038448 (2020).
Karanicolas et al., A de novo protein binding pair by computational design and directed evolution. Mol. Cell 42, 250-260 (2011).
Ke, Three-dimensional structures self-assembled from DNA bricks. Science 338, 1177-1183 (2012).
Keech et al., "First-in-Human Trial of a SARS CoV 2 Recombinant Spike Protein Nanoparticle Vaccine" bioRxiv 2020.08.05.20168435 (2020).
Khare & Fleishman, Emerging themes in the computational design of novel enzymes and protein-protein interfaces. FEBSLett. 587, 1147-1154(2013).
Kim et al., "Respiratory syncytial virus disease in infants despite prior administration of antigenic activated vaccine" Am. J. Epidemiol 89: 422-434 (1969).
King & Lai, Practical approaches to designing novel protein assemblies. Curr. Opin. Struct. Biol. 23, 632-638 (2013).
King et al. Computational design of self-assembling protein nanomaterials with atomic level accuracy. Science 336, 1171-1174 (2012).
King et al., "Accurate design of coassembling multi-component protein nanomaterials" Nature 510(7503):103-108 (Jun. 2014). With supplementary data.
King, "Vaccinology in the Age of Pandemics: Structure-Based Design of Novel Nanoparticle Vaccine Platforms" <https://virtual.keystonesymposia.org/p/s/structure-based-design-of-novel-nanoparticle-vaccine-platforms-14106> [Video] Keystone Symposia eSymposia Jun. 15, 2020.
Kirchdoerfer et al., "Stabilized coronavirus spikes are resistant to conformational changes induced by receptor recognition or proteolysis" Sci Rep 8 15701 (2018).
Koder, et al., "Design and engineering of an O(2) transport protein," Nature, vol. 458, No. 7236, pp. 305-309, 2009.
Kortemme, et al., "Computational redesign of protein-protein interaction specificity," Nature Structural & Molecular Biology, vol. 11, No. 4, pp. 371-379, 2004.
PCT/US2016/020090, International Search Report and Written Opinion, 10 pages, 2016.
Walls et al., "Elicitation of potent neutralizing antibody responses by designed protein nanoparticle vaccines for SARS-CoV-2" bioRxiv https://doi.org/10.1101/2020.08.11.247395 (2020).
Walls et al., "Elicitation of Potent Neutralizing Antibody Responses by Designed Protein Nanoparticle Vaccines for SARS-CoV-2." Cell 183(5): 1367-1382 (2020).
Walls et al., "Glycan shield and epitope masking of a coronavirus spike protein observed by cryo-electron microscopy" Nat. Struct. Mol. Biol. 23: 899-905 (2016b).
Walls et al., "Structure, Function, and Antigenicity of the SARS-CoV-2 Spike Glycoprotein" Cell 181: 281-292.e286 (2020).
Walls et al., "Tectonic conformational changes of a coronvirus spike glycoprotein promote membrane fusion" Proc. Natl. Acad. Sci. USA 114: 11157-62 (2017).
Walls et al., "Unexpected Receptor Functional Mimicry Elucidates Activation of Coronavirys Fusion" Cell 176: 1026-39.e1015 (2019).
Wang, et al., "Expanding the genetic code of *Escherichia coli*," Science, vol. 292, No. 5516, pp. 498-500, 2001.
Wang et al., "A human monoclonal antibody blocking SARS-CoV-2 infection" bioRxiv 2020.2003.2011.987958 (2020).
Wang et al., "Structural and Functional Basis of SARS-CoV-2 Entry by Using Human ACE2" Cell 181: 894-904.e899 (2020).
Watanabe et al. "Site-specific glycan analysis of the SARS-CoV-2 spike" Science 369 (6501): 330-333 (2020).
Weis et al., "Semi-automated data processing of hydrogen exchange mass spectra using Hexpress" J. Am. Soc. Mass Spectrom. 17: 1700-1703 (2006).
Whitehead, et al., "Optimization of Affinity, Specificity and Function of Designed Influenza Inhibitors Using Deep Sequencing," Nature Biotechnology, vol. 30, No. 6, pp. 543-548, 2012.
Winn, et al., "Macromolecular TLS refinement in REFMAC at moderate resolutions," Methods in Enzymology, vol. 374, pp. 300-321, 2003.
Woo et al., "Molecular diversity of coronaviruses in bats" Virology 351, 180-187 (2006).
Worsdorfer et al., Directed evolution of a protein container. Science 331, 589-592 (2011).

(56) References Cited

OTHER PUBLICATIONS

Worsdorfer et al., Efficient in vitro encapsulation of protein cargo by an engineered protein container. J.Am.Chem.Soc.134,909-911(2012).
Wrapp et al., "Cryo-EM structure of the 2019-nCoV spike in the prefusion conformation" Science 367: 1260-63 (2020).
Wu, et al., "Cyclic GMP-AMP is an endogenous second messenger in innate immune signaling by cytosolic DNA," Science, vol. 339, No. 6121, pp. 826-830, 2013.
Wu et al., "A noncompeting pair of human neutralizing antibodies block COVID-19 virus binding to its receptor ACE2" Science 368: 1274-78 (2020).
Xiong et al., "Glycan Shield and Fusion Activation of a Deltacoronavirus Spike Glycoprotein Fine-Tuned for Enteric Infections" J. Virol. 92 (2018).
Xiong et al., "A thermostable, closed SARS-CoV-2 spike protein trimer" Nat. Struct. Mol. Biol. (2020).
Yan et al., "Structural basis for the recognition of SARS-CoV-2 by full-length human ACE2." Science 367: 1444-48 (2020).
Yang et al., "Two Mutations Were Critical for Bat-to-Human Transmission of Middle East Respiratory Syndrome Coronavirus" J. Virol. 89: 9119-123 (2015).
Yeates et al., "Bacterial microcompartment organelles: protein shell structure and evolution," Annual Review of Biophysics, vol. 39, pp. 185-205, 2010.
Yee et al., "Generation of high-titer pseudotyped retroviral vectors with very broad host range," Methods in Cell Biology, vol. 43, Pt A, pp. 99-112, 1994.
Yu et al., "DNA vaccine protection against SARS-CoV-2 in rhesus macaques" Science 369(6505): 806-811 (2020).
Yuan et al., "A highly conserved cryptic epitope in the receptor-binding domains of SARS-CoV-2 and SARS-CoV" Science 368(6491): 630-633 (2020).
Zaccai, et al., "A de novo peptide hexamer with a mutable channel," Nature Chemical Biology, vol. 7, No. 12, pp. 935-941, 2011.
Zacharias, et al., "Partitioning of lipid-modified GFPs into membrane microdomains in live cells," Science, vol. 296, No. 5569, pp. 913-916, 2002.
Zakeri et al., Peptide tag forming a rapid covalent bond to a protein, through engineering a bacterial adhesin, Proc. Natl. Acad. Sci. U.S.A. 109(12):E690-E697 (Mar. 2012).
Zandi et al., Origin of icosahedral symmetry in viruses, Proc. Natl. Acad. Sci. U.S.A. 101(44):15556-560 (Nov. 2004).
Zhang, "Fabrication of novel biomaterials through molecular self-assembly," Nature Biotechnology, vol. 21, No. 10, pp. 1171-1178, 2003.
Zhang et al., "Improved protein hydrogen/deuterium exchange mass spectrometry platform with fully automated data processing" Anal. Chem. 84: 4942-4949 (2012).
Zhang et al., "Prefusion spike protein stabilization through computational mutagenesis." Biorxiv, doi: 10.1101/2020.06.17.157081 (2020).
Zhang et al., "Propagated Perturbations from a Peripheral Mutation Show Interactions Supporting WW Domain Thermostability" Structure 26(11):1474-1485.e5 (2018).
Zhao, et al., "A simple guide to biochemical approaches for analyzing lipid-protein interactions," Molecular Biology of the Cell, vol. 23, No. 15, pp. 2823-2830, 2012.
Zhao et al., "Nanoparticle vaccines" Vaccine 32(3): 327-37 (2014).
Zheng, et al., "From molecular to macroscopic via the rational design of a self-assembled 3D DNA crystal," Nature, vol. 461, No. 7260, pp. 74-77, 2009.
Zhou et al., Genetically encoded short peptide tags for orthogonal protein labeling by Sfp and AcpS phosphopantetheinyl transferases. ACS Chem. Biol. 2, 337-346 (2007).
Zhou et al., "Structural basis for the neutralization of SARS-CoV-2 by an antibody from a convalescent patient" Nat. Struct. Mol. Biol. 27(10): 950-958 (2020).
Zhou et al., "A Novel Bat Coronavirus Closely Related to SARS-CoV2 Contains Natural Insertions at the S1/S2 Cleavage Site of the Spike Protein" Curr. Biol 30: 2196-2203.e2193 (2020).
Zhou et al., "A pneumonia outbreak associated with a new coronavirus of probably bat origin" Nature 579 (7798): 270-273 (2020).
Zhu et al., "Safety, tolerability, and immunogenicity of a recombinant adenovirus type-5 vectored COVID-19 vaccine: a dose-escalation, open-label, non-randomised, first-in-human trial" Lancet 395: 1845-1854 (2020).
Zhu et al., "A Novel Coronavirus from Patients with Pneumonia in China" N. Engl. J. Med. 382(8): 727-733 (2020).
Zost et al., "Potently neutralizing and protective human antibodies against SARS-CoV-2" Nature 584: 443-449 (2020).
Zlotnick et al., A Theoretical Model Successfully Identifies Features of Hepatitis B Virus Capsid Assembly, Biochemistry 38:14644-652 (1999).
Zlotnick et al., Mechanism of Capsid Assembly for an Icosahedral Plant Virus, Virology 277:450-56 (2000).
Zschoche & Hilvert, Diffusion-Limited Cargo Loading of an Engineered Protein Container, Am. Chem. Soc. 137:16121-132 (2015).
The International Search Report and Written Opinion from International Application No. PCT/US2018/025880; dated Jun. 29, 2018, pp. 1-19.
PCT/US2014/015371 International Search Report and Written Opinion, 2014.
Crowley, et al., "Structural insight into the mechanisms of transport across the *Salmonella enterica* Pdu microcompartment shell," Journal of Biological Chemistry, vol. 285, No. 48, pp. 37838-37846, 2010.
Cymer et al., "Mechanisms of integral membrane protein insertion and folding" J. Mol. Biol. 427(5): 999-1022 (2015).
Dai et al., "A Universal Design of Betacoronavirus Vaccines against COVID-19, MERS, and SARS" Cell 182(3): 722-33 (2020).
Das, et al., "Simultaneous prediction of protein folding and docking at high resolution," Proceedings of the National Academy of Sciences USA, vol. 106, No. 45, pp. 18978-18983, 2009.
Davis et al., "Sera from Individuals with Narrowly Focused Influenza Virus Antibodies Rapidly Select Viral Escape Mutations" J. Virol. 92 (19): e00859-18 (2018).
Davis et al. MolProbity: all-atom contacts and structure validation for proteins and nucleic acids. Nucleic Acids Res. 35, W375-383 (2007).
De Felipe et al., "E unum pluribus: Multiple proteins from a self-processing polyprotein" Trends Biotechnol. 24(2): 68-75 (2006).
De Guzman, et al., "Structure of the HIV-1 nucleocapsid protein bound to the SL3 psi-RNA recognition element," Science, vol. 279, No. 5349, pp. 384-388, 1998.
Delany et al., "Vaccines for the 21st century" EMBO Mol. Med. 6(6): 708-20 (2014).
Dempsey et al., C3d of Complement as a Molecular Adjuvant: Bridging Innate and Acquired Immunity, Science, 271:348-50 (Jan. 1996).
Deng et al., "Double-layered protein nanoparticles induce broad protection against divergenet influenza A viruses" Nat Commun 359(9): 1-12 (2018).
Denks et al., "The Sec translocon mediated protein transport in prokaryotes and eukaryotes" Molecular Membrane Biology 31: 58-84 (2014).
Der et al., Metal-mediated affinity and orientation specificity in a computationally designed protein homodimer. J. Am. Chem. Soc. 134, 375-385 (2012).
Des Rieux et al., "Nanoparticles as potential oral delivery systems of proteins and vaccines: A mechanistic approach" Journal of Controlled Release 116(1): 1-27 (2006).
DiMaio et al., Modeling symmetric macromolecular structures in Rosetta3. PLoS ONE 6, e20450 (2011).
Dinnon et al., "A mouse-adapted SARS-CoV-2 model for the evaluation of COVID-19 medical countermeasures" bioRxiv 2020. 2005.2006.081497 (2020).
Donnelly et al., "Analysis of the aphthovirus 2A/2B polyprotein "cleavage" mechanisms indicates not a proteolytic reaction, but a novel translational effect: A putative ribosomal "skip"" J. Gen. Virol. 82(5): 1013-25 (2001).

(56) References Cited

OTHER PUBLICATIONS

Douglas & Young, Viruses: making friends with old foes. Science 312, 873-875 (2006).
Draper et al., "Malaria Vaccines: Recent Advances and New Horizons" Cell Host Microbe 24(1): 43-56 (2018).
Dyer et al., High-Throughput SAXS for the Characterization of Biomolecules in Solution: A Practical Approach, Methods Mol. Biol. 1091:245-58 (2014).
Edwards et al., "Cold sensitivity of the SARS-CoV-2 spike ectodomain" bioRxiv https://doi.org/10.1101/2020.07.12.199588 (2020).
Emsley et al., Features and development of Coot. Acta Crystallogr. D Biol. Crystallogr. 66, 486-501 (2010).
Erasmus et al., "An Alphavirus-derived replicon RNA vaccine induces SARS-CoV-2 neutralizing antibody and T cell responses in mice and nonhuman primates" Sci. Transl. Med. 12(555):eabc9396 (2020).
Fallas et al., Computational Design of Self-Assembling Cyclic Protein Homo-oligomers, Nat. Chem. 9(4):353-60 (Apr. 2017).
Fleishman, et al., "Hotspot-centric de novo design of protein binders," Journal of Molecular Biology, vol. 413, No. 5, pp. 1047-1062, 2011.
Fleishman et al., Computational design of proteins targeting the conserved stem region of influenza hemagglutinin. Science 332, 816-821 (2011).
Fleishman et al. Community-wide assessment of protein-interface modeling suggests improvements to design methodology. J. Mol. Biol. 414, 289-302 (2011).
Fleishman et al. RosettaScripts: a scripting language interface to the Rosetta macromolecular modeling suite. PLoS One 6, e20161 (2011).
Fleishman et al., Restricted sidechain plasticity in the structures of native proteins and complexes. Protein Sci. 20, 753-757 (2011).
Fletcher et al. Self-assembling cages from coiled-coil peptide modules. Science 340, 595-599 (2013).
Folegatti et al., "Safety and immunogenicity of the ChAdOx1 nCoV-19 vaccine against SARS-CoV-2: a preliminary report of a phase 1/2, single-blind, randomised controlled trial" Lancet 396(10249): 467-78 (2020).
Frank et al. SPIDER and WEB: processing and visualization of images in 3D electron microscopy and related fields. J. Struct. Biol. 116, 190-199 (1996).
Freed, et al., "Single amino acid changes in the human immunodeficiency virus type 1 matrix block virus particle production," Journal of Virology, vol. 68, No. 8, pp. 5311-5320, 1994.
Frokjaer et al., "Protein drug stability: a formulation challenge" Nat. Rev. Drug Discov. 4(4):298-306 (2005).
Gaschen et al., "Diversity considerations in HIV-1 vaccine selection" Science 296 (5577): 2354-60 (2022).
Gen Bank Accession MN908947, Severe acute respiratory syndrome coronavirus 2 isolate Wuhan-Hu-1, complete genome p. 1-10 (2020).
Gentili, et al., "Transmission of innate immune signaling by packaging of cGAMP in viral particles," Science, vol. 349, No. 6253, pp. 1232-1236, 2015.
Georgiev et al., "Two-Component Ferritin Nanoparticles for Multimerization of Diverse Trimeric Antigens." ACS Infect Dis. May 11, 2018;4(5):788-796. doi: 10.1021/acsinfecdis.7b00192. Epub Mar. 6, 2018. PMID: 29451984—Abstract provided.
Gibson et al. Enzymatic assembly of DNA molecules up to several hundred kilobases. Nat. Methods 6, 343-345 (2009).
Glen et al., A Randomized, Blinded, Controlled, Dose-Ranging Study of a Respiratory Syncytial Virus Recombinant Fusion, J. Infect. Dis. 213(3):411-22 (2016).
Goddard et al., "UCSF ChimeraX: Meeting modern challenges in visualization and analysis" Protein Sci. 27: 14-25 (2018).
Golovanov, et al., "A Simple Method for Improving Protein Solubility and Long-Term Stability," Journal of the American Chemical Society, vol. 126, No. 29, pp. 8933-8939, 2004.
Gonen et al., Design of ordered two-dimensional arrays mediated by noncovalent protein-protein interfaces, Science 348:1365-68 (2015).
Goodsell & Olson, Structural symmetry and protein function. Annu. Rev. Biophys. Biomol. Struct. 29, 105-153 (2000).
Gosser, et al., "Peptide-triggered conformational switch in HIV-1 RRE RNA complexes," Nature Structural Biology, vol. 8, No. 2, pp. 146-150, 2001.
Graham et al., "Structure-Based Vaccine Antigen Design" Annu. Rev. Med. 70(1): 91-104 (2019).
Graham, "Rapid COVID-19 vaccine development" Science 368: 945-946 (2020).
Gray et al., "Cutting Edge: cGAS is Required for Lethal Autoimmune Disease in the Trex1-Deficient Mouse Model of Aicardi-Goutieres Syndrome," Journal of Immunology, vol. 195, No. 5, pp. 1939-1943, 2015.
Gribbon, et al., "MagicWand: a single, designed peptide that assembles to stable, ordered alpha-helical fibers," Biochemistry, vol. 47, No. 39, pp. 10365-10371, 2008.
Griffiths, et al., "Cloning, isolation and characterization of the Thermotoga maritima KDPG aldolase," Bioorganic & Medicinal Chemistry, vol. 10, No. 3, pp. 545-550, 2002.
Lopez-Sagaseta et al. "Self-assembling nanoparticles in the design of vaccines". Computational and structural Biotech. Journal. 14: 58-68, (Nov. 2015).
Okba et al. "Particulate multivalent presentation of the receptor binding domain induces protective immune responses against MERS-CoV". Emerg Microbes Infect. 9(1):1080-1091, (Dec. 2020).
International Search Report and Written Opinion for PCT/US2021/017799 mailed Jun. 15, 2021.
Murshudov, et al., "Refinement of macromolecular structures by the maximum-likelihood method," Acta Crystallographica, Section D: Biological Crystallography, vol. 53, Pt 3, pp. 240-255, 1997.
NCBI, GenBank Accession No. PDB: 5KP9_B, 'Chain B, EPN-01*', Dec. 16, 2019.
Nishikawa et al., "Computational prediction of O-linked glycosylation sites that preferentially map to intrinsically disordered regions of extracellular proteins" Int. J. Mol. Sci. 11(12): 4991-5008 (2010).
Nyathi et al., "Co-translational targeting and translocation of proteins to the endoplasmic reticulum" Biochim. Biophys. Acta. Mol. Cell. Res. 1833 (11): 2392-402 (2013).
Otwinowski, et al., "[20] Processing of X-ray diffraction data collected in oscillation mode," Methods in Enzymology, vol. 276, pp. 307-326, 1997.
Padilla et al., Nanohedra: using symmetry to design self assembling protein cages, layers, crystals, and filaments. Proc. Natl Acad. Sci. USA 98, 2217-2221 (2001).
Pagny et al., "Protein recycling from the Golgi apparatus to the endoplasmic reticulum in plants and its minor contribution to calreticulin retention" Plant Cell 12(5):739-56 (2000).
Pallesen et al., "Immunogenicity and structures of a rationally designed prefusion MERS-CoV spike antigen" Proc Natl Acad Sci USA 114(35):E7348-E7357 (2017).
Pardi et al., "mRNA vaccines—a new era in vaccinology" Nat. Rev. Drug Discov. 17: 261-279 (2018).
Pedelacq et al., "Engineering and characterization of a superfolder green fluorescent protein" Nat. Biotechnol. 24(1): 79-88 (2006).
Pettersen et al. UCSF Chimera—a visualization system for exploratory research and analysis. J. Comput. Chem. 25, 1605-1612 (2004).
Phippen et al., "Multivalent Display of Antifreeze Proteins by Fusion to Self-Assembling Protein Cages Enhances Ice-Binding Activiteis," Biochemistry 55:490 6811-6820 (2016).
Pica et al., "Toward a Universal Influenza Virus Vaccine: Prospects and Challenges" Annu. Rev. Med 64(1): 189-202 (2013).
Pinder et al., "Isolation and Characterization of Antigen-Specific Plasmablasts Using a Novel Flow Cytometry-Based lg Capture Assay" J. Immunol. 199(12): 4180-8 (2017).
Plotkin, "Vaccines: past, present and future Early successes" Nat Med 11(4): 5-11 (2005).
Polack et al., "A role for immune complexes in enhanced respiratory syncytial virus disease" J. Exp. Med 196: 859-865 (2002).
Prodromou & Pearl, Recursive PCR: a novel technique for total gene synthesis. Protein Eng. 5, 827-829 (1992).

(56) References Cited

OTHER PUBLICATIONS

Puglisi, et al., "Solution structure of a bovine immunodeficiency virus Tat-TAR peptide-RNA complex," Science, vol. 270, No. 5239, pp. 1200-1203, 1995.
Pulendran et al., "Immunological mechanisms of vaccination" Nat. Immunol. 12(6): 509-17 (2011).
Q8KRX6_9ACTN, the sequence of the SAM-dependent methyltransferase of Streptomyces narbonesis, NCBI_TaxID= 67333, last updated 2019 as version 41 (Year: 2019).
Ra et al., "Lumazine synthase protein cage nanoparticles as antigen delivery nanoplatforms for dendritic cell-based vaccine development" Clin. Exp. Vaccine Res. 3(2): 227 (2014).
Raman et al., Design of Peptide Nanoparticles Using Simple Protein Oligomerization Domains, The Open Nanomedicine Journal, 2:15-26 (2009).
Raman et al., Materials Science: Structure-based design of peptides that self-assemble into regular polyhedral nanoparticles, Nanomedicine: Nanotechnology, Biology, and Medicine 2:95-102 (2006).
Remacle et al., "Substrate cleavage analysis of furin and related proprotein convertases: A comparative study" J. Biol. Chem. 283(30): 20897-906 (2008).
Remot et al., "Nucleoprotein nanostructures combined with adjuvants adapted to the neonatal immune context: a candidate mucosal RSV vaccine." PLoS One 7(5): e37722 (2012).
Resh, "Covalent lipid modifications of proteins," Current Biology, vol. 23, No. 10, pp. R431-R435, 2013.
Resh, "Fatty acylation of proteins: new insights into membrane targeting of myristoylated and palmitoylated proteins," Biochimica et Biophysica Acta, vol. 1451, No. 1, pp. 1-16, 1999.
Ringler & Schulz, Self-Assembly of Proteins into Designed Networks, Science 302:106-09 (2003).
Robbiani et al., "Converent antibody responses to SARS-CoV-2 in convalescent individuals" Nature 584(7821): 437-442 (2020).
Rockx et al., "Structural basis for potent cross-neutralizing human monoclonal antibody protection against lethal human and zoonotic severe acute respiratory syndrome coronavirus challenge" J. Virol. 82: 322-35 (2008).
Rosa, et al., "HIV-1 Nef promotes infection by excluding SERINC5 from virion incorporation," Nature, vol. 526, No. 1572, pp. 212-217, 2015.
Rossen et al., "The viral spike protein is not involved in the polarized sorting of coronaviruses in epithelial cells" J. Virol. 72: 497-503 (1998).
Rothemund, Folding DNA to create nanoscale shapes and patterns. Nature 440, 297-302 (2006).
Website: http://www.genisphere.com/, 1 page retreived on Sep. 12, 2016.
A0A4P2AVB8_STRVZ, the sequence of the SAM-dependent methyltransferase of Streptomyces venezuelae, Strain=ATCC 15068, one page, last updated 2020 (Year: 2020).
Adams et al., PHENIX: a comprehensive Python-based system for macromolecular structure solution. Acta Crystallogr. D Biol. Crystallogr. 66, 213-221 (2010).
AfosrApan, "Computational design of self- and co-assembling protein nanomaterials with atomic level accuracy" available online at: https://community.apan.org/afosr/w/researchareas/7659.human-performance-and-biosystems.aspx, 2014.
Air, "Influenza virus antigenicity and broadly neutralizing epitopes" Curr. Opin. Virol. 11: 113-21 (2015).
Alsoussi et al., "A Potently Neutralizing Antibody Protects Mice against SARS-CoV-2 Infection." J. Immunol. 205(4):915-22 (2020).
Andersen, et al., "Self-assembly of a nanoscale DNA box with a controllable lid," Nature, vol. 459, No. 7243, pp. 73-76, 2009.
Antanasijevic et al., "Structural and functional evaluation of de novo-designed, two-component nanoparticle carriers for HIV Env trimer immunogens." bioRxiv 2020.01.31.929273 (2020).
Anthony et al., "Further Evidence for Bats as the Evolutionary Source of Middle East Respiratory Syndrome Coronavirus." MBio 8(2):e00373-17 (2017).
Anywaine et al., "Safety and Immunogenicity of a 2-Dose Heterologous Vaccination Regimen with Ad26.ZEBOV and MVA-BN-Filo Ebola Vaccines: 12-Month Data From a Phase 1 Randomized Clinical Trial in Uganda and Tanzania" J. Infect. Dis. 220(1): 46-56 (2019).
Apolonia, et al., "Promiscuous RNA binding ensures effective encapsidation of APOBEC3 proteins by HIV-1," PLoS Pathogens, vol. 11, No. 1, e1004609, 2015.
Arnold & Volkov, Directed evolution of biocatalysts. Curr. Opin. Chem. Biol. 3, 54-59 (1999).
Bagby, et al., "[2]—Optimization of Protein Solubility and Stability for Protein Nuclear Magnetic Resonance," Methods in Enzymology, vol. 339, pp. 20-41, 2001.
Bale et al., Structure of a designed tetrahedral protein assembly variant engineered to have improved soluble expression, Protein Sci. 24:1695-1701 (2015).
Bale et al., "Accurate design of megadalton-scale two-component icosahedral protein complexes," Science 353(6297):389-94 (Jul. 2016).
Ballister, et al., "In vitro self-assembly of tailorable nanotubes from a simple protein building block," Proceedings of the National Academy of Sciences USA, vol. 105, No. 10, pp. 3733-3738, 2008.
Barnes et al. "Structures of Human Antibodies Bound to SARS-CoV-2 Spike Reveal Common Epitoes and Recurrent Features of Antibodies" Cell 182(4): 828-842 (2020).
Barney & King, "Vaccinology in the Age of Pandemics: Live Q&A with Drs. Graham and King" <https://virtual.keystonesymposia.org/p/s/live-qa-with-drs-graham-and-king-14111> [VIDEO] Keystone Symposia eSymposia Jun. 15, 2020.
Barney & King, "Vaccinology in the Age of Pandemics: Structure-Based Antigen Design" <https://virtual.keystonesymposia.org/p/s/full-session-structure-based-antigen-design-14096> [Video] Keystone Symposia eSymposia Jun. 15, 2020.
Bhaskar et al., "Reengineering Redox Sensitive GFP to Measure Mycothiol Redox Potential of *Mycobacterium tuberculosis* during infection" PLoS Pathog. 10(1) (2014).
Bieniasz, "Late budding domains and host proteins in enveloped virus release," Virology, vol. 344, No. 1, pp. 55-63, 2006.
Biswas, et al., "The human immunodeficiency virus type 1 ribosomal frameshifting site is an invariant sequence determinant and an important target for antiviral therapy," Journal of Virology, vol. 78, No. 4, pp. 2082-2087, 2004.
Blanc, et al., "Refinement of severely incomplete structures with maximum likelihood in BUSTER-TNT," Acta Carystallographica, Section D: Biological Crystallography, vol. 60, Pt 12, Pt 1, pp. 2210-2221, 2004.
Boder et al., "Yeast surface display for directed evolution of protein expression, affinity, and stability" Methods Enzymol. 328 (1999): 430-44 (2000).
Bondos, et al., "Detection and Prevention of Protein Aggregation Before, During, and After Purification," Analytical Biochemistry, vol. 316, No. 2, pp. 223-231, 2003.
Boyington et al., "Structure-Based Design of Head-Only Fusion Glycoprotein Immunogens for Respiratory Synctial Virus." PLoS One 11(7): e0159709 (2016).
Boyle et al., Squaring the circle in peptide assembly: from fibers to discrete nanostructures by de novo design. J. Am. Chem. Soc. 134, 15457-15467 (2012).
Boyoglu-Barnum et al., "Elicitation of broadly protective immunity to influenza by multivalent hemagglutinin nanoparticle vaccines" bioRxiv, 2020.2005.2030.125179 (2020).
Braakman et al., "Protein Folding in the Endoplasmic Reticulum" Compr. Biotechnol. Second Ed. 1:217-27 (2011).
Bradley & Baker, Improved beta-protein structure prediction by multilevel optimization of nonlocal strand pairings and local backbone conformation. Proteins 65, 922-929 (2006).
Bridgeman, et al., "Viruses transfer the antiviral second messenger cGAMP between cells," Science, vol. 349, No. 6253, pp. 1228-1232, 2015.
Brodin et al., et al. Metal-directed, chemically tunable assembly of one-, two- and three-dimensional crystalline protein arrays. Nature Chem. 4, 375-382 (2012).

(56) References Cited

OTHER PUBLICATIONS

Brouwer et al., "Enhancing and shaping the immunogenicity of native-like HIV-1 envelope trimers with a two-component protein nanoparticle." Nat. Commun. 10, 4272 (2019).
Brouwer et al., "Potential neutralizing antibodies from COVID-19 patients define multiple targets of vulnerability" Science 369(6504): 643-650 (2020).
Bruun et al., "Engineering a Rugged Nanoscaffold to Enhance Plug-and Display Vaccination" ACS Nano 12(9): 8855-66 (2018).
Burkhard et al., Malaria vaccine based on Self-Assembling Protein Nanoparticles, Expert Rev. Vaccines 14(12):1525-27 (2015).
Burton et al., "Broadly Neutralizing Antibodies to HIV and Their Role in Vaccine Design" Annu. Rev. Immunol. 34(1):635-59 (2016).
Butterfield et al., "Evolution of a designed protein assembly encapsulation its own RNA genome" Nature 552(7685): 415-20 (2017).
Caspar & Klug, The Principles in the Construction of Regular Viruses, Cold Spring Harb. Symp. Quant. Biol. 27, 1-24 (1962).
Cavrois, et al., "A sensitive and specific enzyme-based-assay detecting HIV-1 virion fusion in primary T lymphocytes," Nature Biotechology, vol. 20, No. 11, pp. 1151-1154, 2002.
Chan et al. Structure and function of P19, a high-affinity iron transporter of the human pathogen Campylobacter jejuni. J. Mol. Biol. 401, 590-604 (2010).
Chao, et al., "Isolating and Engineering Human Antibodies Using Yeast Surface Display," Nature Protocols, vol. 1, No. 2, pp. 755-768, 2016.
Chao, et al., "Structural basis for the coevolution of a viral RNA-protein complex," Nature Structural & Molecular Biology, vol. 15, No. 1, pp. 103-105, 2008.
Cherf et al., "Applications of yeast surface display for protein engineering" Methods Mol. Biol. 1319: 155-75 (2015).
Chuang et al., "High-throughput sorting of the highest producing cell via a transiently protein-anchored system" PLoS One 9(7): 1-7 (2014).
Colovos & Yeates, Verification of protein structures: patterns of nonbonded atomic interactions. Protein Sci. 2, 1511-1519 (1993).
Cooper, et al., "Predicting protein structures with a multiplayer online game," Nature, vol. 466, No. 7307, pp. 756-760, 2010.
Corbett et al., "SARS-CoC-2 mRNA vaccine desing enable by prototype pathogen preparedness" Nature 586(7830): 567-71 (2020).
Correia et al., Proof of principle for epitope-focused vaccine design, Nature 507(7491):201-06 (2014).
Corti et al., "Prophylactic and postexposure efficacy of a potent human monoclonal antibody against MERS coronavirus." PNAS 112(33): 10473-8 (2015).
Ryan et al., "Cleavage of foot-and-mouth disease virus polyprotein is mediated by residues located within a 19 amino acid sequence" J. Gen. Virol 72 (11): 2727-32 (1991).
Sahin et al., "Concurrent human antibody and TH1 type T-cell responses elicited by a COVID-19 RNA vaccine" medRxiv 2020.2007.2017.20140533 (2020).
Salgado, et al., "Controlling protein-protein interactions through metal coordination: assembly of a 16-helix bundle protein," Journal of the American Chemical Society, vol. 129, No. 44, pp. 13374-13375, 2007.
Salgado et al., Metal-directed protein self-assembly. Acc. Chem. Res. 43, 661-672 (2010).
Schindelin et al. Fiji: an open-source platform for biological-image analysis. Nat. Methods 9, 676-682 (2012).
Schneidman-Duhovny et al., "Accurate SAXS Profile Computation and its Assessment by Contrast Variation Experiements," Biophysical Journal, Aug. 2013, pp. 962-974, vol. 105.
Schneidman-Duhovny et al., "FoXS: a web server for rapid computation and fitting of SAXS profiles," Nucleic Acids Research, 2010, pp. W540-W544, vol. 38.
Schrodinger, LLC, "The PyMOL Molecular Graphics System, Version 1.4," available online at: http://www.pymol.org, 2011.
Schuck, "Size-distribution analysis of macromolecules by sedimentation velocity ultracentrifugation and lamm equation modeling," Biophysical Journal, vol. 78, No. 3, pp. 1606-1619, 2000.
Seeman, Nanomaterials based on DNA. Annu. Rev. Biochem. 79, 65-87 (2010).
Seo et al., "A Three Dimensional Nanostructured Array of Protein Nanoparticle," Adv. Funct. Mater. 20, 4055-4061 (2010).
Seydoux et al., "Characterization of neutralizing antibodies from a SARS-CoV-2 infected individual" bioRxiv 2020.2005.2012.091298 (2020).
Shang et al., "Structural basis of receptor recognition by SARS-CoV-2" Nature 581(7807):221-224 (2020).
Sheffler & Baker, RosettaHoles2: a volumetric packing measure for protein structure refinement and validation. Protein Sci 19, 1991-1995 (2010).
Shu et al., Hemagglutinin partial [Influenza A virus (A/California/07/2009 (H 1 N 1))]. Gen Bank: ACP41953.1, Dep. Jun. 1, 2009 (2009).
Skwarczynski et al., "Peptide-based synthetic vaccines" Chem. Sci. 7, 842-854 (2016).
Sinclair et al., Generation of protein lattices by fusing proteins with matching rotational symmetry. Nature Nanotechnol. 6, 558-562 (2011).
Sinclair, Constructing arrays of proteins. Curr. Opin. Chem. Biol. 17, 946-951 (2013).
Smith, XIMDISP—A visualization tool to aid structure determination from electron microscope images. J. Struct. Biol. 125, 223-228 (1999).
Smith et al., "Thinking Outside the Triangle Replication Fidelity of the Largest RNA Viruses" Annu. Rev. Virol. 1: 111-32 (2014).
Stahelin, "Lipid binding domains: more than simple lipid effectors," Journal of Lipid Research, vol. 50, Suppl S299-S304, 2009.
Starr et al., "Deep mutational scanning of SARS-COV-2 receptor binding domain reveals contraints on folding and ACE2 binding." bioRxiv 2020.06.17.157982 (2020).
Stettler et al., "Specificity, cross-reactivity, and function of antibodies elicited by Zika virus infection" Science 353: 823-26 (2016).
Stranges et al., Computational design of a symmetric homodimer using beta-strand assembly. Proc. Natl Acad. Sci. USA 108, 20562-20567 (2011).
Sun, et al., "Cyclic GMP-AMP synthase is a cytosolic DNA sensor that activates the type I interferon pathway," Science, vol. 339, No. 6121, pp. 786-791, 2013.
Taylor et al., "Deletion and anergy of polyclonal B cells specific for ubiquitous membrane-bound self-antigen" J. Exp. Med. 209: 2065-77 (2012).
Ter Meulen et al., "Human monoclonal antibody combination against SARS coronavirus: synergy and coverage of escape mutants" PLoS Med. 3, e237 (2006).
Thery, et al., "Isolation and Characterization of Exosomes from Cell and Culture Supernatants and Biological Fluids," Current Protocols in Cell Biology, Chapter 3, Unit 3.22, pp. 3.22.1-3.22.19, 2006.
Thomas et al., "From protein traffic to embryogenesis and disease" Nat. Rev. Mol. Cell Biol. 3(10): 753-66 (2002).
Tobiume, et al., "Nef does not affect the efficiency of human immunodeficiency virus type 1 fusion with target cells," Journal of Virology, vol. 77, No. 19, pp. 10645-10650, 2003.
Tinberg et al. Computational design of ligand-binding proteins with high affinity and selectivity. Nature 501, 212-216 (2013).
Tordello et al., "Type VI secretion system sheaths as nanoparticles for antigen display" Proc Natl. Acad. Sci. 113: 3042-3047 (2016).
Tortorici et al., "Structural insights into coronavirus entry" Adv. Virus Res. 105: 93-116 (2019).
Traggiai et al., "An efficient method to make human monoclonal antibodies from memory B cells: potent neutralization of SARS coronavirus" Nat. Med. 10: 871-75 (2004).
Tramuto et al., Hemagglutinin, partial [Influenza B Virus (B/Palermo/4/2013)]. Gen Bank AM B72169.1, Dep. May 11, 2016 (2016).
Tsai, et al., "Analysis of lattice-translocation disorder in the layered hexagonal structure of carboxysome shell protein CsoS1C," Acta Crystallographica, Section D: Biological Crystallography, vol. 65, Pt 9, pp. 980-988, 2009.
Tsvetkova, et al., "Cutting edge: an NK cell-independent role for Slamf4 in controlling humoral autoimmunity," Protein Cages, Methods in Molecular Biology, 1252:1-15, 2014.

(56) References Cited

OTHER PUBLICATIONS

Ueda et al., "Tailored design of protein nanoparticle scaffolds for multivalent presentation of viral glycoprotein antigens" Elife 9 (2020).
Ulmer et al., "Vaccine manufacturing: challenges and solutions" Nat. Biotechnol. 24(11):1377-83 (2006).
UNIPROT Q8KRX6, "The desosamine biosynthetic cluster of Streptomyces narbonensi, producer of narbomycin," Bate and Cundliff, 2002, one page, version 1, obtained from the Internet Oct. 9, 2020 from www.uniprot.org website (Year: 2002).
Usami, et al., "SERINC3 and SERINC5 restrict HIV-1 infectivity and are counteracted by Nef," Nature, vol. 526, No. 1572, pp. 218-223, 2015.
Usui et al. Nanoscale elongating control of the self-assembled protein filament with the cysteine-introduced building blocks. Protein Sci. 18, 960-969 (2009).
Van Heel et al., A new generation of the IMAGIC image processing system. J. Struct. Biol. 116, 17-24 (1996).
Van Kooten & Banchereau, CD40-CD40 Ligand, J. Leukoc. Biol. 67:2-17 (Jan. 2000).
Vartak et al., "Recent advances in subunit vaccine carriers" Vaccines 4(2): 1-18 (2016).
Verkerke et al., "Epitope-Independent Purification of Native-Like Envelope Trimers from Diverse HIV-1 Isolates" J. Virol. 90: 9471-82 (2016).
Voet et al., Computational design of a self-assembling symmetrical β-propeller protein, Proc. Natl. Acad. Sci. U.S.A. 111:15102-107 (2014).
Vottler et al., "Designed proteins induce the formation of nanocage-containing extracellular vesicles," Nature 640(6732): 292-295 (2016).
Votteler, et al., "Virus budding the ESCRT pathway," Cell Host & Microbe, vol. 14, No. 3, pp. 232-241, 2013.
Walls et al., "Cryo-electron microscopy structure of a coronavirus spike glycoprotein trimer" Nature 531: 114-117 (2016).
Kremer, et al., "Computer visualization of three-dimensional image data using IMOD," Journal of Structural Biology, vol. 116, No. 1, pp. 71-76, 1996.
Kremer et al., "Evidence for single-dose protection by the bivalent HPV vaccine—Review of the Costa Rica HPV vaccine trial and future research studies" Vaccine 36: 4774-4782 (2018).
Krenkova et al., "Oriented immobilization of peptide N-glycosidase F on a monolithic support for glycosylation analysis" J. Chromatogr A 1322: 54-61 (2013).
Krishnamurty et al., "Somatically Hypermutated Plasmodium-Specific lgM(+) Memory B Cells Are Rapid, Plastic, Early Responders upon Malaria Rechallenge" Immunity 45: 402-414 (2016).
Krissinel & Henrick, Inference of macromolecular assemblies from crystalline state. J. Mol. Biol. 372, 774-797 (2007).
Kuhlman & Baker, Native protein sequences are close to optimal for their structures. Proc. Natl Acad. Sci. USA 97, 10383-10388 (2000).
Kumar, et al., "Crystal structure analysis of icosahedral lumazine synthase from *Salmonella typhimurium*, an antibacterial drug target," Acta Crystallographica, Section D: Biological Crystallography, vol. 67, Pt 2, pp. 131-139, 2011.
Kumru et al., "Vaccine instability in the cold chain: mechanisms, analysis, and formulation strategies" Biologicals 42: 237-259 (2014).
Kuo et al., "Development of CpG-adjuvanted stable prefusion SARS-CoV-2 spike antigen as a subunit vaccine against COVID-19." Scientific Reports 10: 20085 doi: 10.1038/s41598-020-77077-z (2020).
Lai et al., Structure of a Designed Protein Cage that Self-Assembles into a Highly Porous Cube, Nat. Chem. 6:1065-71 (2014).
Lai et al., Principles for designing ordered protein assemblies. Trends Cell Biol. 22, 653-661 (2012).
Lai et al., Structure of a 16-nm cage designed by using protein oligomers. Science 336:1129-30 (Jun. 2012).
Lan et al., "Structure of the SARSCoV-2 spike receptor binding domain bound to the ACE2 receptor" Nature 581(7807): 215-220 (2020).
Lanci et al. Computational design of a protein crystal. Proc. Natl Acad. Sci. USA 109, 7304-7309 (2012).
Laskowski, et al., "PROCHECK: a program to check the stereochemical quality of protein structures," Journal of Applied Crystallography, 26:283-291, 1993.
Lawrence & Colman, Shape complementarity at protein/protein interfaces. J. Mol. Biol. 234, 946-950 (1993).
Lawrence et al., Supercharging Proteins Can Impart Unusual Resilience, J. Am. Chem. Soc. 129, 10110-10112 (2007).
Leaver-Fay et al., ROSETTA3: an object-oriented software suite for the simulation and design of macromolecules. Methods Enzymol. 487, 545-574 (2011).
Leaver-Fay et al. Scientific benchmarks for guiding macromolecular energy function improvement. Methods Enzymol. 523, 109-143 (2013).
Lee et al., "Complete humanization of the mouse immunoglobulin loci enables efficient therapeutic antibody discovery" Nat. Biotechnol. 32: 356-63 (2014).
Lee et al., "Mapping person-to-person variation in viral mutations that escape polyclonal serum targeting influenza hemagglutinin" Elife 8 (2019).
Lemmon, "Membrane recognition by phospholipid-binding domains." Nature Reviews Molecular Cell Biology, vol. 9, No. 2, pp. 99-111, 2008.
Letko et al., "Functional assessment of cell entry and receptor usage for SARS-CoV-2 and other lineage B betacoronaviruses" Nature Microbiology 5(4): 562-69 (2020).
Levy, et al., "3D complex: a structural classification of protein complexes," PLoS Computational Biology, vol. 2, No. 11, e155, pp. 1395-1406, 2006.
Lovejoy, et al., "Crystal structure of a synthetic triple-stranded alpha-helical bundle," Science, vol. 259, No. 5099, pp. 1288-1293, 1993.
Li et al., "Angiotensin-converting enzyme 2 is a functional receptor for the SARS coronavirus" Nature 426: 450-4 (2003).
Li et al., "The Impact of Mutations in SARS-CoV-2 Spike on Viral Infectivity and Antigenicity" Cell 182(5):1284-1294.e9 (2020).
Li et al., "Transmission dynamics and evolutionary history of 2019-nCoV" J. Med. Virol. 92: 501-11 (2020).
Lin et al., Structural Fingerprinting: Subgrouping of Comoviruses by Structural Studies of Red Clover Mottle Virus to 2.4-Å Resolution and Comparisons with Other Comoviruses J. Virol. 74, 493-504 (2000).
Lin et al., The Refined Crystal Structure of Cowpea Mosaic Virus at 2.8 Å Resolution, Virology 265, 20-34 (1999).
Liu et al., "Systematic comparison of 2A peptides for cloning multi-genes in a polycistronic vector" Sci. Rep. 7(1): 1-9 (2017).
Long et al., "Molecular Architecture of Early Dissemination and Massive Second Wave of the SARS-CoV-2 Virus in a Major Metropolitan Area" mBio 11(6):e02707-20 (2020).
Ludtke et al., EMAN: semiautomated software for high-resolution single-particle reconstructions. J. Struct. Biol. 128, 82-97 (1999).
Lüthy et al., Assessment of protein models with three-dimensional profiles. Nature 356, 83-85 (1992).
Lyumkis, et al., "Cryo-EM structure of a fully glycosylated soluble cleaved HIV-1 envelope timer," Science, vol. 342, No. 6165, pp. 1484-1490, 2013.
Mandolesi et al., "SARS-CoV-2 protein subunit vaccination elicits potent neutralizing antibody responses." bioRxiv 2020.2007.2031. 228486 (2020).
Mangeot, et al., "Protein transfer into human cells by VSV-G-induced nanovesicles," Molecular Therapy, vol. 19, No. 9, pp. 1656-1666, 2011.
Marcandalli et al., "Induction of Potent Neutralizing Antibody Responses by a Designed Protein Nanoparticle Vaccine for Respiratory Syncytial Virus" Cell 176: 1420-31.e17 (2019).
McCallum et al., "Structure-guided covalent stabilization of coronavirus spike glycoprotein trimers in the closed conformation" Nat. Struct. Mol. Biol. 27(10): 942-49 (2020).
Mccoy et al. Phaser crystallographic software. J. Appl. Crystallogr. 40, 658-674 (2007).

(56) References Cited

OTHER PUBLICATIONS

McCullough, et al., "Membrane Fission Reactions of the Mammalian ESCRT Pathway," Annual Review of Biochemistry, vol. 82, pp. 663-692, 2013.
McDonald, et al., "No strings attached: the ESCRT machinery in viral budding and cytokinesis," Journal of Cell Science, vol. 122, Pt 13, pp. 2167-2177, 2009.
Mclellan et al., "Structure-based Design of a Fusion Glycoprotein Vaccine for Respiratory Syncytial Virus" Science 342(6158):592-98 (Nov. 2013).
Menachery et al., "A SARS-like cluster of circulating bat coronaviruses shows potential for human emergence" Nat. Med. 21: 1508-13 (2015).
Menachery et al., "SARS-like WIV-CoV poised for human emergence" Proc Natl Acad Sci USA 113: 3048-53 (2016).
Millet et al., "Murine Leukemia Virus (MLV)-based Coronavirus Spike-pseudotyped Particle Production and Infection" Bio. Protoc. 6 (2016).
Mindell, et al., "Accurate determination of local defocus and specimen tilt in electron microscopy," Journal of Structural Biology, vol. 142, No. 3, pp. 334-347, 2003.
Morein et al., "Subunit vaccines against enveloped viruses: virosomes, micelles and other protein complexes." Vaccines 3(2): 83-93 (1985).
Moyle et al., "Modern Subunit Vaccines: Development, Components, and Research Opportunities" ChemMedChem 8: 360-376 (2013).
Mulligan et al., "Phase 1/2 Study to Describe the Safety and Immunogenicity of a COVID-19 RNA Vaccine Candidate (BTN162b1) in Adults 18 to 55 Years of Age: Interim Report" medRxiv 2020. 2006.2030. 20142570 (2020).
Leyrat et al. "Structure and Self-Assembly of the Calcium Binding Matrix Protein of Human Metapneumovirus" Structure: 22(1): 136-148 (2013).
Rodriguez et al., "Caraterizacion antigenica e immunogenica de la proteina del metaneumovirus human y comparacion con la del virus respiratorio sincitial humano" <https://repositorio.uam.es/bitstream/handle/10486/668016/rodriguez_garcia_laura.pdf?sequence=1&isAllowed=y> (Abstract Only) Retrieved from the Internet (2015).
Ahmed et al., "Preliminary identification of potential vaccine targets for the COVID-19 coronavirus (SARS-CoV-2) based on SARS-CoV immunological studies" bioRxiv 2020.02.03.933226: 1-20 (2020).
Pimentel et al., "Peptide nanoparticles as novel immunogens: design and analysis of a prototypic severe acute respiratory syndrome vaccine" Chem. Biol. Drug. Des. 73(1): 53-61 (2009).
Yang et al., "Bioinspired and Biomimetic Nanotherapies for the Treatment of Infectious Diseases" Front. Pharmacol. 10(751): 1-17 (2019).

* cited by examiner

POLYPEPTIDES, COMPOSITIONS, AND THEIR USE TO TREAT OR LIMIT DEVELOPMENT OF AN INFECTION

CROSS REFERENCE

This application is a U.S. national phase of International Application No. PCT/US2021/017799, filed Feb. 12, 2021, which claims priority to U.S. Provisional Application Ser. No. 62/977,036 filed Feb. 14, 2020; 63/046,159, filed: Jun. 30, 2020, and 63/064,235, filed: Aug. 11, 2020; all incorporated by reference herein in their entirety.

FEDERAL FUNDING STATEMENT

This invention was made with government support under Grant Nos. HHSN272201700059C and R01 GM120553, awarded by the National Institutes of Health. The government has certain rights in the invention.

SEQUENCE LISTING STATEMENT

A computer readable form of the Sequence Listing is filed with this application by electronic submission and is incorporated into this application by reference in its entirety. The Sequence Listing is contained in the file created on Feb. 22, 2024, having the file name "20-1008-WO-US_amended.txt" and is 1,118,061 bytes in size.

BACKGROUND

The recent emergence of a previously unknown virus in Wuhan, China has resulted in the ongoing COVID-19 pandemic that has caused more than 18,700,000 infections and 700,000 fatalities as of Aug. 6, 2020 (WHO). Rapid viral isolation and sequencing revealed by January 2020 that the newly emerged zoonotic pathogen was a coronavirus closely related to SARS-COV and was therefore named SARS-COV-2. SARS-COV-2 is believed to have originated in bats based on the isolation of the closely related RaTG13 virus from *Rhinolophus affinis* and the identification of the RmYN02 genome sequence in metagenomics analyses of *Rhinolophus malayanus*, both from Yunnan, China.

SUMMARY

In one aspect, the disclosure provides polypeptides comprising an amino acid sequence at least 95%, at least 96%, at least 97%, at least 98%, at least 99%, or at least 100% identical to the amino acid sequence selected from the group consisting of SEQ ID NOS: 1-84, 138-146, and 167-184, wherein X1 is absent or is an amino acid linker, and wherein residues in parentheses are optional and may be present or some or all of the optional residues may be absent. In various specific embodiments, the polypeptides comprise the amino acid sequence selected from the group consisting of SEQ ID NOS: 1-12 and 142-151, comprise the amino acid sequence selected from the group consisting of SEQ ID NOS: 1-8, or comprise the amino acid sequence selected from the group consisting of SEQ ID NOS: 1 or 5. In another embodiment, the disclosure provides nanoparticles comprising a plurality of such polypeptides.

In another aspect, the disclosure provides nanoparticles, comprising:

(a) a plurality of first assemblies, each first assembly comprising a plurality of identical first proteins; and, (b) a plurality of second assemblies, each second assembly comprising a plurality of second proteins;

wherein the amino acid sequence of the first protein differs from the sequence of the second protein; wherein the plurality of first assemblies non-covalently interact with the plurality of second assemblies to form the nanoparticle; and wherein the nanoparticle displays on its surface an immunogenic portion of a SARS-COV-2 antigen or a variant or homolog thereof, present in the at least one second protein. In one embodiment, the second proteins comprises an amino acid sequence at least 95%, at least 96%, at least 97%, at least 98%, at least 99%, or at least 100% identical to the amino acid sequence selected from the group consisting of SEQ ID NOS: 85-124 or 185-193, or consisting of SEQ ID NOS: 85-88, wherein X1 for at least one second protein comprises an immunogenic portion of a SARS-CoV-2 antigen or a variant or homolog thereof, X2 is absent or an amino acid linker, and residues in parentheses are optional. In another embodiment, X1 in at least 20%, 30%, 40%, 50%, 60%, 70%, 80%, 90%, or 100% of the second proteins comprises an amino acid sequence having at least 75%, 80%, 85%, 90%, 91%, 92%, 93%, 94%, 95%, 96%, 97%, 98%, 99%, or 100% amino acid sequence identity to a Spike(S) protein extracellular domain (ECD) amino acid sequence, an S1 subunit amino acid sequence, an S2 subunit amino acid sequence, an S1 receptor binding domain (RBD) amino acid sequence, and/or an N-terminal domain (NTD) amino acid sequence, from SARS-COV-2, or a variant or homolog thereof. In a further embodiment, X1 in at least 20%, 30%, 40%, 50%, 60%, 70%, 80%, 90%, or 100% of the second proteins comprises an amino acid sequence having at least 75%, 80%, 85%, 90%, 91%, 92%, 93%, 94%, 95%, 96%, 97%, 98%, 99%, or 100% amino acid sequence identity to the amino acid sequence selected from the group consisting of SEQ ID NO: 125-137. In a further embodiment, the first protein comprises an amino acid sequence at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or some or all of the optional residues may be absent.

In various other aspects, the disclosure provides compositions comprising a plurality of nanoparticles disclosed herein, nucleic acid molecules, such as mRNA, encoding the polypeptide disclosed herein, expression vectors comprising the nucleic acid molecules disclosed herein operatively linked to a suitable control sequence, cells comprising the polypeptide, the nanoparticle, the composition, the nucleic acid, and/or the expression vector disclosed herein, and pharmaceutical compositions, kits, and vaccines comprising the polypeptide, the nanoparticle, the composition, the nucleic acid, the expression vector, and/or the cell disclosed herein.

In another aspect, the disclosure provides methods to treat or limit development of a SARS-COV-2 infection, comprising administering to a subject in need thereof an amount effective to treat or limit development of the infection the polypeptide, nanoparticle, composition, nucleic acid, pharmaceutical composition, or vaccine disclosed herein.

DETAILED DESCRIPTION

Figure 1:
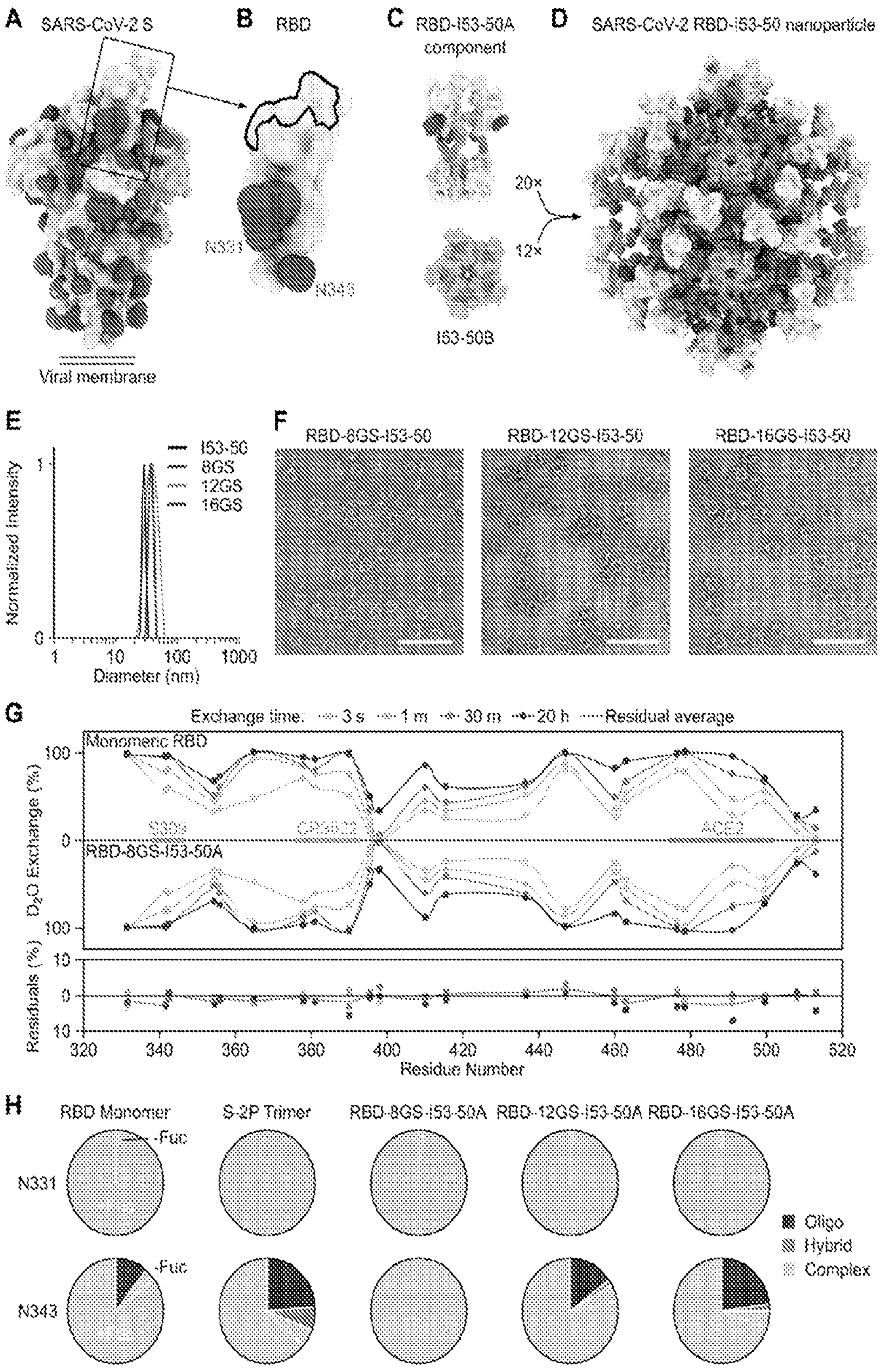
FIG. 1 (A-H). Design, In Vitro Assembly, and Characterization of SARS-COV-2 RBD Nanoparticle Immunogens (A) Molecular surface representation of the SARS-COV-2 S-2P trimer in the prefusion conformation (PDB 6VYB). The glycan at position N343 was modeled based on PDB 6WPS and the receptor-binding motif (RBM) was modeled from PDB 6M0J). The single open RBD is boxed. (B) Molecular surface representation of the SARS-COV-2 S RBD, including the N-linked glycans at positions 331 and 343. The ACE2 receptor-binding site or RBM is indicated with a black outline. (C) Structural models of the trimeric RBD-I53-50A and pentameric I53-50B components. Upon mixing in vitro, 20 trimeric and 12 pentameric components assemble to form nanoparticle immunogens with icosahedral symmetry. Each nanoparticle displays 60 copies of the RBD. (D) Structural model of the RBD-12GS-I53-50 nanoparticle immunogen. Although a single orientation of the displayed RBD antigen and 12-residue linker are shown for simplicity, these regions are expected to be flexible relative to the I53-50 nanoparticle scaffold. (E) Dynamic light scattering (DLS) of the RBD-8GS-, RBD-12GS-, and RBD-16GS-I53-50 nanoparticles compared to unmodified I53-50 nanoparticles. (F) Representative electron micrographs of negatively stained RBD-8GS-, RBD-12GS-, and RBD-16GS-I53-50 nanoparticles. The samples were imaged after one freeze/thaw cycle. Scale bars, 100 nm. (G) Hydrogen/Deuterium-exchange mass spectrometry of monomeric RBD versus trimeric RBD-8GS-I53-50A component, represented here as a butterfly plot, confirms preservation of the RBD conformation, including at epitopes recognized by known neutralizing Abs. In the plot, each point along the horizontal sequence axis represents a peptide where deuterium uptake was monitored from 3 seconds to 20 hours. Error bars shown on the butterfly plot indicate standard deviations from two experimental replicates. The difference plot below demonstrates that monomeric RBD and RBD-8GS-I53-50A are virtually identical in local structural ordering across the RBD. (H) Pie charts summarizing the glycan populations present at the N-linked glycosylation sites N331 and N343 in five protein samples: monomeric RBD, S-2P trimer, and RBD-8GS-, RBD-12GS-, and RBD-16GS-I53-50A trimeric components. The majority of the complex glycans at both sites were fucosylated; minor populations of afucosylated glycans are set off by dashed lines. Oligo, oligomannose.

All references cited are herein incorporated by reference in their entirety. Within this application, unless otherwise stated, the techniques utilized may be found in any of several well-known references such as: Molecular Cloning: A Laboratory Manual (Sambrook, et al., 1989, Cold Spring Harbor Laboratory Press), Gene Expression Technology (Methods in Enzymology, Vol. 185, edited by D. Goeddel, 1991. Academic Press, San Diego, CA), "Guide to Protein Purification" in Methods in Enzymology (M. P. Deutshcer, ed., (1990) Academic Press, Inc.); PCR Protocols: A Guide to Methods and Applications (Innis, et al. 1990. Academic Press, San Diego, CA), Culture of Animal Cells: A Manual of Basic Technique, 2nd Ed. (R. I. Freshney. 1987. Liss, Inc. New York, NY), Gene Transfer and Expression Protocols, pp. 109-128, ed. E. J. Murray, The Humana Press Inc., Clifton, N.J.), and the Ambion 1998 Catalog (Ambion, Austin, TX).

As used herein, the singular forms "a", "an" and "the" include plural referents unless the context clearly dictates otherwise.

As used herein, "about" means+/−5% of the recited parameter.

As used herein, the amino acid residues are abbreviated as follows: alanine (Ala; A), asparagine (Asn; N), aspartic acid (Asp; D), arginine (Arg; R), cysteine (Cys; C), glutamic acid (Glu; E), glutamine (Gln; Q), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

All embodiments of any aspect of the disclosure can be used in combination, unless the context clearly dictates otherwise.

Unless the context clearly requires otherwise, throughout the description and the claims, the words 'comprise', 'comprising', and the like are to be construed in an inclusive sense as opposed to an exclusive or exhaustive sense; that is to say, in the sense of "including, but not limited to". Words using the singular or plural number also include the plural and singular number, respectively. Additionally, the words "herein," "above," and "below" and words of similar import, when used in this application, shall refer to this application as a whole and not to any particular portions of the application.

In a first aspect, the disclosure provides polypeptides comprising an amino acid sequence at least 95%, at least 96%, at least 97%, at least 98%, at least 99%, or at least 100% identical to the amino acid sequence selected from the group consisting of SEQ ID NOS: 1-84, 138-146, and 167-184, wherein X1 is absent or is an amino acid linker, and wherein residues in parentheses are optional and may be present or some or all of the optional residues may be absent.

As shown in the examples that follow, the polypeptides of this aspect can be used to generated self-assembling protein nanoparticle immunogens that elicit potent and protective antibody responses against SARS-COV-2. The nanoparticle vaccines induce neutralizing antibody titers roughly ten-fold higher than the prefusion-stabilized S ectodomain trimer despite a more than five-fold lower dose. Antibodies elicited by the nanoparticle immunogens target multiple distinct epitopes, suggesting that they may not be easily susceptible to escape mutations, and exhibit a significantly lower binding: neutralizing ratio than convalescent human sera, which may minimize the risk of vaccine-associated enhanced respiratory disease.

The amino acid sequence of exemplary polypeptides of this aspect of the disclosure are provided below.

TABLE 1

| Protein name | Protein type | Expressed sequence (optional residues in parentheses; X1 is optional linker) |
|---|---|---|
| SARS-CoV-2 RBD-I53-50A*-16GS-he-His | SARS-CoV-2-I53-50A fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 1) |
| | | (mgilpspgmpallslvsllsvllmgcva)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(GGSGGSGSGGSGGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(SEQ ID NO: 2) |
| | | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST((X1)KMEELFKKHKIVAVLRANSVEEAIEKAVAVFAGGVHLIEITFTVPDADTVIKALSVLKEKGAIIGAGTVTSVEQARKAVESGAEFI |

TABLE 1-continued

| Protein name | Protein type | Expressed sequence (optional residues in parentheses; X1 is optional linker) |
|---|---|---|
| | | VSPHLDEEISQFAKEKGVFYMPGVMTPTELVKAMKLGHTILKLFPGEVVGPQFVKAMKG<br>PFPNVKFVPTGGVNLDNVAEWFKAGVLAVGVGSALVKGTPDEVREKAKAFVEKIRGATE<br>(SEQ ID NO: 3 |
| | | (mgilpspgmpallslvsllsvllmgcva)RFPNITNLCPFGEVFNATRFASVYAWNRK<br>RISNCVADYSVLYNSASFSTFKCYGVSPTKLNDLCFTNVYADSFVIRGDEVRQIAPGQT<br>GKIADYNYKLPDDFTGCVIAWNSNNLDSKVGGNYNYLYRLFRKSNLKPFERDISTEIYQ<br>AGSTPCNGVEGFNCYFPLQSYGFQPTNGVGYQPYRVVVLSFELLHAPATVCGPKKST(X<br>1)KMEELFKKHKIVAVLRANSVEEAIEKAVAVFAGGVHLIEITFTVPDADTVIKALSVL<br>KEKGAIIGAGTVTSVEQARKAVESGAEFIVSPHLDEEISQFAKEKGVFYMPGVMTPTEL<br>VKAMKLGHTILKLFPGEVVGPQFVKAMKGPFPNVKFVPTGGVNLDNVAEWFKAGVLAVG<br>VGSALVKGTPDEVREKAKAFVEKIRGATE (SEQ ID NO: 4) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT<br>NGVGYQPYRVVVLSFELLHAPATVCGPKKST(GGSGGSGSGGSGGSGSEKAAKAEEAA<br>R)KMEELFKKHKIVAVLRANSVEEAIEKAVAVFAGGVHLIEITFTVPDADTVIKALSVL<br>KEKGAIIGAGTVTSVEQARKAVESGAEFIVSPHLDEEISQFAKEKGVFYMPGVMTPTEL<br>VKAMKLGHTILKLFPGEVVGPQFVKAMKGPFPNVKFVPTGGVNLDNVAEWFKAGVLAVG<br>VGSALVKGTPDEVREKAKAFVEKIRGATE (SEQ ID NO: 5) |
| | | (mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>ST(GGSGGSGSGGSGGSGSEKAAKAEEAAR)KMEELFKKHKIVAVLRANSVEEAIEKAV<br>AVFAGGVHLIEITFTVPDADTVIKALSVLKEKGAIIGAGTVTSVEQARKAVESGAEFIV<br>SPHLDEEISQFAKEKGVFYMPGVMTPTELVKAMKLGHTILKLFPGEVVGPQFVKAMKGP<br>FPNVKFVPTGGVNLDNVAEWFKAGVLAVGVGSALVKGTPDEVREKAKAFVEKIRGATE<br>(SEQ ID NO: 6) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT<br>NGVGYQPYRVVVLSFELLHAPATVCGPKKST(X1)KMEELFKKHKIVAVLRANSVEEAI<br>EKAVAVFAGGVHLIEITFTVPDADTVIKALSVLKEKGAIIGAGTVTSVEQARKAVESGA<br>EFIVSPHLDEEISQFAKEKGVFYMPGVMTPTELVKAMKLGHTILKLFPGEVVGPQFVKA<br>MKGPFPNVKFVPTGGVNLDNVAEWFKAGVLAVGVGSALVKGTPDEVREKAKAFVEKIRG<br>ATE (SEQ ID NO: 7) |
| | | mgilpspgmpallslvsllsvllmgcvaetgt)RFPNITNLCPFGEVFNATRFASVYAW<br>NRKRISNCVADYSVLYNSASFSTFKCYGVSPTKLNDLCFTNVYADSFVIRGDEVRQIAP<br>GQTGKIADYNYKLPDDFTGCVIAWNSNNLDSKVGGNYNYLYRLFRKSNLKPFERDISTE<br>IYQAGSTPCNGVEGFNCYFPLQSYGFQPTNGVGYQPYRVVVLSFELLHAPATVCGPKKS<br>T(GGSGGSGSGGSGGSGSEKAAKAEEAAR)KMEELFKKHKIVAVLRANSVEEAIEKAVA<br>VFAGGVHLIEITFTVPDADTVIKALSVLKEKGAIIGAGTVTSVEQARKAVESGAEFIVS<br>PHLDEEISQFAKEKGVFYMPGVMTPTELVKAMKLGHTILKLFPGEVVGPQFVKAMKGPF<br>PNVKFVPTGGVNLDNVAEWFKAGVLAVGVGSALVKGTPDEVREKAKAFVEKIRGATE<br>((SEQ ID NO: 8) |
| | | (mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>ST(GGSGGSGSGGSGGSGSEKAAKAEEAAR)KMEELFKKHKIVAVLRANSVEEAIEKAV<br>AVFAGGVHLIEITFTVPDADTVIKALSVLKEKGAIIGAGTVTSVEQARKAVESGAEFIV<br>SPHLDEEISQFAKEKGVFYMPGVMTPTELVKAMKLGHTILKLFPGEVVGPQFVKAMKGP<br>FPNVKFVPTGGVNLDNVAEWFKAGVLAVGVGSALVKGTPDEVREKAKAFVEKIRGATE<br>(GGSHHHHHHHH) (SEQ ID NO: 9) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT<br>NGVGYQPYRVVVLSFELLHAPATVCGPKKST(GGSGGSGSGGSGGSGSEKAAKAEEAA<br>R)KMEELFKKHKIVAVLRANSVEEAIEKAVAVFAGGVHLIEITFTVPDADTVIKALSVL<br>KEKGAIIGAGTVTSVEQARKAVESGAEFIVSPHLDEEISQFAKEKGVFYMPGVMTPTEL<br>VKAMKLGHTILKLFPGEVVGPQFVKAMKGPFPNVKFVPTGGVNLDNVAEWFKAGVLAVG<br>VGSALVKGTPDEVREKAKAFVEKIRGATE(GGSHHHHHHHH) (SEQ ID NO: 10) |
| | | (mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>ST(X1)KMEELFKKHKIVAVLRANSVEEAIEKAVAVFAGGVHLIEITFTVPDADTVIKA<br>LSVLKEKGAIIGAGTVTSVEQARKAVESGAEFIVSPHLDEEISQFAKEKGVFYMPGVMT<br>PTELVKAMKLGHTILKLFPGEVVGPQFVKAMKGPFPNVKFVPTGGVNLDNVAEWFKAGV<br>LAVGVGSALVKGTPDEVREKAKAFVEKIRGATE(GGSHHHHHHHH)<br>(SEQ ID NO: 11 - - -) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT |

TABLE 1-continued

| Protein name | Protein type | Expressed sequence (optional residues in parentheses; X1 is optional linker) |
|---|---|---|
| | | NGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 12 - - -) |
| SARS-CoV-2 RBD-I53-50A*-8GS-he-His | SARS-CoV-2-I53-50A fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE SEQ ID NO: 13)<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 14)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 15)<br>ETGTRFPNITNLCPFGEVEFATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 16)<br>RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST( )KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 17)<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 18)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST (X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 19)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST (X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 20) |

TABLE 1-continued

| Protein name | Protein type | Expressed sequence (optional residues in parentheses; X1 is optional linker) |
|---|---|---|
| SARS-CoV-2 RBD-I53-50A*-12GS-he-His | SARS-CoV-2-I53-50A fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 21) |
| | | (mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 22) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 23) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 24) |
| | | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 25) |
| | | (mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 26) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 27) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 28) |

TABLE 1-continued

| Protein name | Protein type | Expressed sequence (optional residues in parentheses; X1 is optional linker) |
| --- | --- | --- |
| SARS-CoV-2 2PSGA G-S-TEV-FO-I53-50A*-12GS-he-His | SARS-CoV-2-I53-50A fusion protein | QCVNLTTRTQLPPAYTNSFTRGVYYPDKVFRSSVLHSTQDLFLPFFSNVTWFHAIHVSGTNGTKRFDNPVLPFNDGVYFASTFKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKgsgrenlyfqgggsgyipeaprdgqayvrkdgewvllstflgGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE SEQ ID NO: 29) |
| | | (mgilpspgmpallslvsllsvllmgcvaetgt)QCVNLTTRTQLPPAYTNSFTRGVYYPDKVFRSSVLHSTQDLFLPFFSNVTWFHAIHVSGTNGTKRFDNPVLPFNDGVYFASTFKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVINDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKgsgrenlyfqgggsgyipeaprdgqayvrkdgewvllstflgGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 30) |
| | | ETGTQCVNLTTRTQLPPAYTNSFTRGVYYPDKVFRSSVLHSTQDLFLPFFSNVTWFHAIHVSGTNGTKRFDNPVLPFNDGVYFASTFKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKgsgrenlyfqgggsgyipeaprdgqayvrkdgewvllstflgGSGSGGSGGSGSEKAAKAEEAARKMEELFKKHKIVAVLRANSVEEAIEKAVAV |

TABLE 1-continued

| Protein name | Protein type | Expressed sequence (optional residues in parentheses; X1 is optional linker) |
|---|---|---|
| | | FAGGVHLIEITFTVPDADTVIKALSVLKEKGAIIGAGTVTSVEQARKAVESGAEFIVSP HLDEEISQFAKEKGVFYMPGVMTPTELVKAMKLGHTILKLFPGEVVGPQFVKAMKGPEP NVKFVPTGGVNLDNVAEWFKAGVLAVGVGSALVKGTPDEVREKAKAFVEKIRGATE (SEQ ID NO: 31) |
| | | ETGTQCVNLTTRTQLPPAYTNSFTRGVYYPDKVFRSSVLHSTQDLFLPFFSNVTWFHAI HVSGTNGTKRFDNPVLPFNDGVYFASTFKSNIIRGWIFGTTLDSKTQSLLIVNNATNVV IKVCEFQFCNDPFLGVYYHKNNKSWMESEFRVYSSANNCTFEYVSQPFLMDLEGKQGNF KNLREFVFKNIDGYFKIYSKHTPINLVRDLPQGFSALEPLVDLPIGINITRFQTLLALH RSYLTPGDSSSGWTAGAAAYYVGYLQPRTFLLKYNENGTITDAVDCALDPLSETKCTLK SFTVEKGIYQTSNFRVQPTESIVRFPNITNLCPFGEVFNATRFASVYAWNRKRISNCVA DYSVLYNSASFSTFKCYGVSPTKLNDLCFTNVYADSFVIRGDEVRQIAPGQTGKIADYN YKLPDDFTGCVIAWNSNNLDSKVGGNYNYLYRLFRKSNLKPFERDISTEIYQAGSTPCN GVEGFNCYFPLQSYGFQPTNGVGYQPYRVVVLSFELLHAPATVCGPKKSTNLVKNKCVN FNFNGLTGTGVLTESNKKFLPFQQFGRDIADTTDAVRDPQTLEILDITPCSFGGVSVIT PGTNTSNQVAVLYQDVNCTEVPVAIHADQLTPTWRVYSTGSNVFQTRAGCLIGAEHVNN SYECDIPIGAGICASYQTQTNSPSGAGSVASQSIIAYTMSLGAENSVAYSNNSIAIPTN FTISVTTEILPVSMTKTSVDCTMYICGDSTECSNLLLQYGSFCTQLNRALTGIAVEQDK NTQEVFAQVKQIYKTPPIKDFGGFNFSQILPDPSKPSKRSFIEDLLFNKVTLADAGFIK QYGDCLGDIAARDLICAQKFNGLTVLPPLLTDEMIAQYTSALLAGTITSGWTFGAGAAL QIPFAMQMAYRFNGIGVTQNVLYENQKLIANQFNSAIGKIQDSLSSTASALGKLQDVVN QNAQALNTLVKQLSSNFGAISSVLNDILSRLDPPEAEVQIDRLITGRLQSLQTYVTQQL IRAAEIRASANLAATKMSECVLGQSKRVDFCGKGYHLMSFPQSAPHGVVFLHVTYVPAQ EKNFTTAPAICHDGKAHFPREGVFVSNGTHWFVTQRNFYEPQIITTDNTFVSGNCDVVI GIVNNTVYDPLQPELDSFKEELDKYFKNHTSPDVDLGDISGINASVVNIQKEIDRLNEV AKNLNESLIDLQELGKYEQYIKgsgrenlyfqggggsgyipeaprdgqayvrkdgewvl lstflgGSGSGGSGGSGSEKAAKAEEAARKMEELFKKHKIVAVLRANSVEEAIEKAVAV FAGGVHLIEITFTVPDADTVIKALSVLKEKGAIIGAGTVTSVEQARKAVESGAEFIVSP HLDEEISQFAKEKGVFYMPGVMTPTELVKAMKLGHTILKLFPGEVVGPQFVKAMKGPFP NVKFVPTGGVNLDNVAEWFKAGVLAVGVGSALVKGTPDEVREKAKAFVEKIRGATE(GG SHHHHHHHH) (SEQ ID NO: 32) |
| | | QCVNLTTRTQLPPAYTNSFTRGVYYPDKVFRSSVLHSTQDLFLPFFSNVTWFHAIHVSG TNGTKRFDNPVLPFNDGVYFASTFKSNIIRGWIFGTTLDSKTQSLLIVNNATNVVIKVC EFQFCNDPFLGVYYHKNNKSWMESEFRVYSSANNCTFEYVSQPFLMDLEGKQGNFKNLR EFVFKNIDGYFKIYSKHTPINLVRDLPQGFSALEPLVDLPIGINITRFQTLLALHRSYL TPGDSSSGWTAGAAAYYVGYLQPRTFLLKYNENGTITDAVDCALDPLSETKCTLKSFTV EKGIYQTSNFRVQPTESIVRFPNITNLCPFGEVFNATRFASVYAWNRKRISNCVADYSV LYNSASFSTFKCYGVSPTKLNDLCFTNVYADSFVIRGDEVRQIAPGQTGKIADYNYKLP DDFTGCVIAWNSNNLDSKVGGNYNYLYRLFRKSNLKPFERDISTEIYQAGSTPCNGVEG FNCYFPLQSYGFQPTNGVGYQPYRVVVLSFELLHAPATVCGPKKSTNLVKNKCVNFNFN GLTGTGVLTESNKKFLPFQQFGRDIADTTDAVRDPQTLEILDITPCSFGGVSVITPGTN TSNQVAVLYQDVNCTEVPVAIHADQLTPTWRVYSTGSNVFQTRAGCLIGAEHVNNSYEC DIPIGAGICASYQTQTNSPSGAGSVASQSIIAYTMSLGAENSVAYSNNSIAIPTNFTIS VTTEILPVSMTKTSVDCTMYICGDSTECSNLLLQYGSFCTQLNRALTGIAVEQDKNTQE VFAQVKQIYKTPPIKDFGGFNFSQILPDPSKPSKRSFIEDLLFNKVTLADAGFIKQYGD CLGDIAARDLICAQKFNGLTVLPPLLTDEMIAQYTSALLAGTITSGWTFGAGAALQIPF AMQMAYRFNGIGVTQNVLYENQKLIANQFNSAIGKIQDSLSSTASALGKLQDVVNQNAQ ALNTLVKQLSSNFGAISSVLNDILSRLDPPEAEVQIDRLITGRLQSLQTYVTQQLIRAA EIRASANLAATKMSECVLGQSKRVDFCGKGYHLMSFPQSAPHGVVFLHVTYVPAQEKNF TTAPAICHDGKAHFPREGVFVSNGTHWFVTQRNFYEPQIITTDNTFVSGNCDVVIGIVN NTVYDPLQPELDSFKEELDKYFKNHTSPDVDLGDISGINASVVNIQKEIDRLNEVAKNL NESLIDLQELGKYEQYIKgsgrenlyfqggggsgyipeaprdgqayvrkdgewvllstf lg(X1)KMEELFKKHKIVAVLRANSVEEAIEKAVAVFAGGVHLIEITFTVPDADTVIKA LSVLKEKGAIIGAGTVTSVEQARKAVESGAEFIVSPHLDEEISQFAKEKGVFYMPGVMT PTELVKAMKLGHTILKLFPGEVVGPQFVKAMKGPFPNVKFVPTGGVNLDNVAEWFKAGV LAVGVGSALVKGTPDEVREKAKAFVEKIRGATE SEQ ID NO: 33) |
| | | (mgilpspgmpallslvsllsvllmgcvaetgt)QCVNLTTRTQLPPAYTNSFTRGVYY PDKVFRSSVLHSTQDLFLPFFSNVTWFHAIHVSGTNGTKREDNPVLPFNDGVYFASTFK SNIIRGWIFGTTLDSKTQSLLIVNNATNVVIKVCEFQFCNDPFLGVYYHKNNKSWMESE FRVYSSANNCTFEYVSQPFLMDLEGKQGNFKNLREFVFKNIDGYFKIYSKHTPINLVRD LPQGFSALEPLVDLPIGINITRFQTLLALHRSYLTPGDSSSGWTAGAAAYYVGYLQPRT FLLKYNENGTITDAVDCALDPLSETKCTLKSFTVEKGIYQTSNFRVQPTESIVRFPNIT NLCPFGEVFNATRFASVYAWNRKRISNCVADYSVLYNSASFSTFKCYGVSPTKLNDLCF TNVYADSFVIRGDEVRQIAPGQTGKIADYNYKLPDDFTGCVIAWNSNNLDSKVGGNYNY LYRLFRKSNLKPFERDISTEIYQAGSTPCNGVEGFNCYFPLQSYGFQPTNGVGYQPYRV VVLSFELLHAPATVCGPKKSTNLVKNKCVNFNENGLTGTGVLTESNKKFLPFQQFGRDI ADTTDAVRDPQTLEILDITPCSFGGVSVITPGTNTSNQVAVLYQDVNCTEVPVAIHADQ LTPTWRVYSTGSNVFQTRAGCLIGAEHVNNSYECDIPIGAGICASYQTQTNSPSGAGSV ASQSIIAYTMSLGAENSVAYSNNSIAIPTNFTISVTTEILPVSMTKTSVDCTMYICGDS TECSNLLLQYGSFCTQLNRALTGIAVEQDKNTQEVFAQVKQIYKTPPIKDFGGFNFSQI LPDPSKPSKRSFIEDLLFNKVTLADAGFIKQYGDCLGDIAARDLICAQKFNGLTVLPPL LTDEMIAQYTSALLAGTITSGWTFGAGAALQIPFAMQMAYRFNGIGVTQNVLYENQKLI ANQFNSAIGKIQDSLSSTASALGKLQDVVNQNAQALNTLVKQLSSNFGAISSVINDILS RLDPPEAEVQIDRLITGRLQSLQTYVTQQLIRAAEIRASANLAATKMSECVLGQSKRVD FCGKGYHLMSFPQSAPHGVVFLHVTYVPAQEKNFTTAPAICHDGKAHFPREGVFVSNGT HWFVTQRNFYEPQIITTDNTFVSGNCDVVIGIVNNTVYDPLQPELDSFKEELDKYFKNH TSPDVDLGDISGINASVVNIQKEIDRLNEVAKNLNESLIDLQELGKYEQYIKgsgrenl yfqggggsgyipeaprdgqayvrkdgewvllstflg(X1)KMEELFKKHKIVAVLRANS |

TABLE 1-continued

| Protein name | Protein type | Expressed sequence (optional residues in parentheses; X1 is optional linker) |
|---|---|---|
| | | VEEAIEKAVAVFAGGVHLIEITFTVPDADTVIKALSVLKEKGAIIGAGTVTSVEQARKA<br>VESGAEFIVSPHLDEEISQFAKEKGVFYMPGVMTPTELVKAMKLGHTILKLFPGEVVGP<br>QFVKAMKGPFPNVKFVPTGGVNLDNVAEWFKAGVLAVGVGSALVKGTPDEVREKAKAFV<br>EKIRGATE(GGSHHHHHHHH) (SEQ ID NO: 34)<br>ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKgsgrenlyfqgggsgyipeaprdgqayvrkdgewvl<br>lstflg(X1)KMEELFKKHKIVAVLRANSVEEAIEKAVAVFAGGVHLIEITFTVPDADT<br>VIKALSVLKEKGAIIGAGTVTSVEQARKAVESGAEFIVSPHLDEEISQFAKEKGVFYMP<br>GVMTPTELVKAMKLGHTILKLFPGEVVGPQFVKAMKGPFPNVKFVPTGGVNLDNVAEWF<br>KAGVLAVGVGSALVKGTPDEVREKAKAFVEKIRGATE (SEQ ID NO: 35)<br>ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKgsgrenlyfqgggsgyipeaprdgqayvrkdgewvl<br>lstflg(X1)KMEELFKKHKIVAVLRANSVEEAIEKAVAVFAGGVHLIEITFTVPDADT<br>VIKALSVLKEKGAIIGAGTVTSVEQARKAVESGAEFIVSPHLDEEISQFAKEKGVFYMP<br>GVMTPTELVKAMKLGHTILKLFPGEVVGPQFVKAMKGPFPNVKFVPTGGVNLDNVAEWF<br>KAGVLAVGVGSALVKGTPDEVREKAKAFVEKIRGATE(GGSHHHHHHHH)<br>(SEQ ID NO: 36) |
| SARS-CoV-2 2PSGA G-S-I53-50A*-12GS-he-His | SARS-CoV-2-I53-50A fusion protein | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS<br>VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGFIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIKGSGSGGSGGSGSEKAAKAEEAARKMEELFKKHKIVAVLRAN |

TABLE 1-continued

| Protein name | Protein type | Expressed sequence (optional residues in parentheses; X1 is optional linker) |
|---|---|---|
| | | SVEEAIEKAVAVFAGGVHLIEITFTVPDADTVIKALSVLKEKGAIIGAGTVTSVEQARK<br>AVESGAEFIVSPHLDEEISQFAKEKGVFYMPGVMTPTELVKAMKLGHTILKLFPGEVVG<br>PQFVKAMKGPFPNVKFVPTGGVNLDNVAEWFKAGVLAVGVGSALVKGTPDEVREKAKAF<br>VEKIRGATE (SEQ ID NO: 37) |
| | | (mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKLNDLCF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVLNDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH<br>TSPDVDLGDISGINASVVNIQKEIDRLNEVAKNLNESLIDLQELGKYEQYIKGSGSGGS<br>GGSGSEKAAKAEEAARKMEELFKKHKIVAVLRANSVEEAIEKAVAVFAGGVHLIEITFT<br>VPDADTVIKALSVLKEKGAIIGAGTVTSVEQARKAVESGAEFIVSPHLDEEISQFAKEK<br>GVFYMPGVMTPTELVKAMKLGHTILKLFPGEVVGPQFVKAMKGPFPNVKFVPTGGVNLD<br>NVAEWFKAGVLAVGVGSALVKGTPDEVREKAKAFVEKIRGATE(GGSHHHHHHHH)<br>(SEQ ID NO: 38) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKGSGSGGSGGSGSEKAAKAEEAARKMEELFKKHKIVAV<br>LRANSVEEAIEKAVAVFAGGVHLIEITFTVPDADTVIKALSVLKEKGAIIGAGTVTSVE<br>QARKAVESGAEFIVSPHLDEEISQFAKEKGVFYMPGVMTPTELVKAMKLGHTILKLFPG<br>EVVGPQFVKAMKGPFPNVKFVPTGGVNLDNVAEWFKAGVLAVGVGSALVKGTPDEVREK<br>AKAFVEKIRGATE (SEQ ID NO: 39) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKGSGSGGSGGSGSEKAAKAEEAARKMEELFKKHKIVAV<br>LRANSVEEAIEKAVAVFAGGVHLIEITFTVPDADTVIKALSVLKEKGAIIGAGTVTSVE |

TABLE 1-continued

| Protein name | Protein type | Expressed sequence (optional residues in parentheses; X1 is optional linker) |
| --- | --- | --- |
| | | QARKAVESGAEFIVSPHLDEEISQFAKEKGVFYMPGVMTPTELVKAMKLGHTILKLFPG |
| | | EVVGPQFVKAMKGPFPNVKFVPTGGVNLDNVAEWFKAGVLAVGVGSALVKGTPDEVREK |
| | | AKAFVEKIRGATE(GGSHHHHHHHH) (SEQ ID NO: 40) |
| | | QCVNLTTRTQLPPAYTNSFTRGVYYPDKVFRSSVLHSTQDLFLPFFSNVTWFHAIHVSG |
| | | TNGTKRFDNPVLPFNDGVYFASTFKSNIIRGWIFGTTLDSKTQSLLIVNNATNVVIKVC |
| | | EFQFCNDPFLGVYYHKNNKSWMESEFRVYSSANNCTFEYVSQPFLMDLEGKQGNFKNLR |
| | | EFVFKNIDGYFKIYSKHTPINLVRDLPQGFSALEPLVDLPIGINITRFQTLLALHRSYL |
| | | TPGDSSSGWTAGAAAYYVGYLQPRTFLLKYNENGTITDAVDCALDPLSETKCTLKSFTV |
| | | EKGIYQTSNFRVQPTESIVRFPNITNLCPFGEVFNATRFASVYAWNRKRISNCVADYSV |
| | | LYNSASFSTFKCYGVSPTKLNDLCFTNVYADSFVIRGDEVRQIAPGQTGKIADYNYKLP |
| | | DDFTGCVIAWNSNNLDSKVGGNYNYLYRLFRKSNLKPFERDISTEIYQAGSTPCNGVEG |
| | | FNCYFPLQSYGFQPTNGVGYQPYRVVVLSFELLHAPATVCGPKKSTNLVKNKCVNFNFN |
| | | GLTGTGVLTESNKKFLPFQQFGRDIADTTDAVRDPQTLEILDITPCSFGGVSVITPGTN |
| | | TSNQVAVLYQDVNCTEVPVAIHADQLTPTWRVYSTGSNVFQTRAGCLIGAEHVNNSYEC |
| | | DIPIGAGICASYQTQTNSPSGAGSVASQSIIAYTMSLGAENSVAYSNNSIAIPTNFTIS |
| | | VTTEILPVSMTKTSVDCTMYICGDSTECSNLLLQYGSFCTQLNRALTGIAVEQDKNTQE |
| | | VFAQVKQIYKTPPIKDFGGFNFSQILPDPSKPSKRSFIEDLLFNKVTLADAGFIKQYGD |
| | | CLGDIAARDLICAQKFNGLTVLPPLLTDEMIAQYTSALLAGTITSGWTFGAGAALQIPF |
| | | AMQMAYRFNGIGVTQNVLYENQKLIANQFNSAIGKIQDSLSSTASALGKLQDVVNQNAQ |
| | | ALNTLVKQLSSNFGAISSVLNDILSRLDPPEAEVQIDRLITGRLQSLQTYVTQQLIRAA |
| | | EIRASANLAATKMSECVLGQSKRVDFCGKGYHLMSFPQSAPHGVVFLHVTYVPAQEKNF |
| | | TTAPAICHDGKAHFPREGVFVSNGTHWFVTQRNFYEPQIITTDNTFVSGNCDVVIGIVN |
| | | NTVYDPLQPELDSFKEELDKYFKNHTSPDVDLGDISGINASVVNIQKEIDRLNEVAKNL |
| | | NESLIDLQELGKYEQYIK(X1)KMEELFKKHKIVAVLRANSVEEAIEKAVAVFAGGVHL |
| | | IEITFTVPDADTVIKALSVLKEKGAIIGAGTVTSVEQARKAVESGAEFIVSPHLDEEIS |
| | | QFAKEKGVFYMPGVMTPTELVKAMKLGHTILKLFPGEVVGPQFVKAMKGPFPNVKFVPT |
| | | GGVNLDNVAEWFKAGVLAVGVGSALVKGTPDEVREKAKAFVEKIRGATE (SEQ ID |
| | | NO: 41) |
| | | (mgilpspgmpallslvsllsvllmgcvaetgt)QCVNLTTRTQLPPAYTNSFTRGVYY |
| | | PDKVFRSSVLHSTQDLFLPFFSNVTWFHAIHVSGTNGTKRFDNPVLPFNDGVYFASTFK |
| | | SNIIRGWIFGTTLDSKTQSLLIVNNATNVVIKVCEFQFCNDPFLGVYYHKNNKSWMESE |
| | | FRVYSSANNCTFEYVSQPFLMDLEGKQGNFKNLREFVFKNIDGYFKIYSKHTPINLVRD |
| | | LPQGFSALEPLVDLPIGINITRFQTLLALHRSYLTPGDSSSGWTAGAAAYYVGYLQPRT |
| | | FLLKYNENGTITDAVDCALDPLSETKCTLKSFTVEKGIYQTSNFRVQPTESIVRFPNIT |
| | | NLCPFGEVFNATRFASVYAWNRKRISNCVADYSVLYNSASFSTFKCYGVSPTKLNDLCF |
| | | TNVYADSFVIRGDEVRQIAPGQTGKIADYNYKLPDDFTGCVIAWNSNNLDSKVGGNYNY |
| | | LYRLFRKSNLKPFERDISTEIYQAGSTPCNGVEGFNCYFPLQSYGFQPTNGVGYQPYRV |
| | | VVLSFELLHAPATVCGPKKSTNLVKNKCVNFNENGLTGTGVLTESNKKFLPFQQFGRDI |
| | | ADTTDAVRDPQTLEILDITPCSFGGVSVITPGTNTSNQVAVLYQDVNCTEVPVAIHADQ |
| | | LTPTWRVYSTGSNVFQTRAGCLIGAEHVNNSYECDIPIGAGICASYQTQTNSPSGAGSV |
| | | ASQSIIAYTMSLGAENSVAYSNNSIAIPTNFTISVTTEILPVSMTKTSVDCTMYICGDS |
| | | TECSNLLLQYGSFCTQLNRALTGIAVEQDKNTQEVFAQVKQIYKTPPIKDFGGFNFSQI |
| | | LPDPSKPSKRSFIEDLLFNKVTLADAGFIKQYGDCLGDIAARDLICAQKFNGLTVLPPL |
| | | LTDEMIAQYTSALLAGTITSGWTFGAGAALQIPFAMQMAYRFNGIGVTQNVLYENQKLI |
| | | ANQFNSAIGKIQDSLSSTASALGKLQDVVNQNAQALNTLVKQLSSNFGAISSVINDILS |
| | | RLDPPEAEVQIDRLITGRLQSLQTYVTQQLIRAAEIRASANLAATKMSECVLGQSKRVD |
| | | FCGKGYHLMSFPQSAPHGVVFLHVTYVPAQEKNFTTAPAICHDGKAHFPREGVFVSNGT |
| | | HWFVTQRNFYEPQIITTDNTFVSGNCDVVIGIVNNTVYDPLQPELDSFKEELDKYFKNH |
| | | TSPDVDLGDISGINASVVNIQKEIDRLNEVAKNLNESLIDLQELGKYEQYIK(X1)KME |
| | | ELFKKHKIVAVLRANSVEEAIEKAVAVFAGGVHLIEITFTVPDADTVIKALSVLKEKGA |
| | | IIGAGTVTSVEQARKAVESGAEFIVSPHLDEEISQFAKEKGVFYMPGVMTPTELVKAMK |
| | | LGHTILKLFPGEVVGPQFVKAMKGPFPNVKFVPTGGVNLDNVAEWFKAGVLAVGVGSAL |
| | | VKGTPDEVREKAKAFVEKIRGATE(GGSHHHHHHHH) (SEQ ID NO: 42) |
| | | ETGTQCVNLTTRTQLPPAYTNSFTRGVYYPDKVFRSSVLHSTQDLFLPFFSNVTWFHAI |
| | | HVSGTNGTKRFDNPVLPFNDGVYFASTFKSNIIRGWIFGTTLDSKTQSLLIVNNATNVV |
| | | IKVCEFQFCNDPFLGVYYHKNNKSWMESEFRVYSSANNCTFEYVSQPFLMDLEGKQGNF |
| | | KNLREFVFKNIDGYFKIYSKHTPINLVRDLPQGFSALEPLVDLPIGINITRFQTLLALH |
| | | RSYLTPGDSSSGWTAGAAAYYVGYLQPRTFLLKYNENGTITDAVDCALDPLSETKCTLK |
| | | SFTVEKGIYQTSNFRVQPTESIVRFPNITNLCPFGEVFNATRFASVYAWNRKRISNCVA |
| | | DYSVLYNSASFSTFKCYGVSPTKLNDLCFTNVYADSFVIRGDEVRQIAPGQTGKIADYN |
| | | YKLPDDFTGCVIAWNSNNLDSKVGGNYNYLYRLFRKSNLKPFERDISTEIYQAGSTPCN |
| | | GVEGFNCYFPLQSYGFQPTNGVGYQPYRVVVLSFELLHAPATVCGPKKSTNLVKNKCVN |
| | | FNFNGLTGTGVLTESNKKFLPFQQFGRDIADTTDAVRDPQTLEILDITPCSFGGVSVIT |
| | | PGTNTSNQVAVLYQDVNCTEVPVAIHADQLTPTWRVYSTGSNVFQTRAGCLIGAEHVNN |
| | | SYECDIPIGAGICASYQTQTNSPSGAGSVASQSIIAYTMSLGAENSVAYSNNSIAIPTN |
| | | FTISVTTEILPVSMTKTSVDCTMYICGDSTECSNLLLQYGSFCTQLNRALTGIAVEQDK |
| | | NTQEVFAQVKQIYKTPPIKDFGGFNFSQILPDPSKPSKRSFIEDLLFNKVTLADAGFIK |
| | | QYGDCLGDIAARDLICAQKFNGLTVLPPLLTDEMIAQYTSALLAGTITSGWTFGAGAAL |
| | | QIPFAMQMAYRFNGIGVTQNVLYENQKLIANQFNSAIGKIQDSLSSTASALGKLQDVVN |
| | | QNAQALNTLVKQLSSNFGAISSVLNDILSRLDPPEAEVQIDRLITGRLQSLQTYVTQQL |
| | | IRAAEIRASANLAATKMSECVLGQSKRVDFCGKGYHLMSFPQSAPHGVVFLHVTYVPAQ |
| | | EKNFTTAPAICHDGKAHFPREGVFVSNGTHWFVTQRNFYEPQIITTDNTFVSGNCDVVI |
| | | GIVNNTVYDPLQPELDSFKEELDKYFKNHTSPDVDLGDISGINASVVNIQKEIDRLNEV |
| | | AKNLNESLIDLQELGKYEQYIK( )KMEELFKKHKIVAVLRANSVEEAIEKAVAVFAGG |

TABLE 1-continued

| Protein name | Protein type | Expressed sequence (optional residues in parentheses; X1 is optional linker) |
|---|---|---|
| | | VHLIEITFTVPDADTVIKALSVLKEKGAIIGAGTVTSVEQARKAVESGAEFIVSPHLDE<br>EISQFAKEKGVFYMPGVMTPTELVKAMKLGHTILKLFPGEVVGPQFVKAMKGPFPNVKF<br>VPTGGVNLDNVAEWFKAGVLAVGVGSALVKGTPDEVREKAKAFVEKIRGATE (SEQ<br>ID NO: 43) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIK( )KMEELFKKHKIVAVLRANSVEEAIEKAVAVFAGG<br>VHLIEITFTVPDADTVIKALSVLKEKGAIIGAGTVTSVEQARKAVESGAEFIVSPHLDE<br>ISQFAKEKGVFYMPGVMTPTELVKAMKLGHTILKLFPGEVVGPQFVKAMKGPFPNVKFV<br>EPTGGVNLDNVAEWFKAGVLAVGVGSALVKGTPDEVREKAKAFVEKIRGATE(GGSHHH<br>HHHHH) (SEQ ID NO: 44) |
| SARS-CoV-2 RBD-I3-01*-secOpt-8GS-he-His | SARS-CoV-2-I3-01 fusion protein | RFPNITNLCPFGEVFNATRFASVYAWNRKRISNCVADYSVLYNSASFSTFKCYGVSPTK<br>LNDLCFTNVYADSFVIRGDEVRQIAPGQTGKIADYNYKLPDDFTGCVIAWNSNNLDSKV<br>GGNYNYLYRLFRKSNLKPFERDISTEIYQAGSTPCNGVEGFNCYFPLQSYGFQPTNGVG<br>YQPYRVVVLSFELLHAPATVCGPKKSTGGSGGSGSEKAAKAEEAARMEELFKEHKIVAV<br>LRANSVEEAKKKALAVFLGGVDLIEITFTVPDADTVIKELSFLKEMGAIIGAGTVTSVE<br>QAREAVESGAEFIVSPHLDEEISQFAKEEGVFYMPGVMTPTELVKAMKLGHTILKLFPG<br>EVVGPQFVEAMKGPFPNVKFVPTGGVNLDNVAEWFEAGVQAVGVGEALNEGTPVEVAEK<br>AKAFVEKIEGATE (SEQ ID NO: 45) |
| | | (mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>STGGSGGSGSEKAAKAEEAARMEELFKEHKIVAVLRANSVEEAKKKALAVFLGGVDLIE<br>ITFTVPDADTVIKELSFLKEMGAIIGAGTVTSVEQAREAVESGAEFIVSPHLDEEISQF<br>AKEEGVFYMPGVMTPTELVKAMKLGHTILKLFPGEVVGPQFVEAMKGPFPNVKFVPTGG<br>VNLDNVAEWFEAGVQAVGVGEALNEGTPVEVAEKAKAFVEKIEGATE(GGSHHHHHHHH)<br>(SEQ ID NO: 46) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT<br>NGVGYQPYRVVVLSFELLHAPATVCGPKKSTGGSGGSGSEKAAKAEEAARMEELFKEHK<br>IVAVLRANSVEEAKKKALAVFLGGVDLIEITFTVPDADTVIKELSFLKEMGAIIGAGTV<br>TSVEQAREAVESGAEFIVSPHLDEEISQFAKEEGVFYMPGVMTPTELVKAMKLGHTILK<br>LFPGEVVGPQFVEAMKGPFPNVKFVPTGGVNLDNVAEWFEAGVQAVGVGEALNEGTPVE<br>VAEKAKAFVEKIEGATE (SEQ ID NO: 47) |
| | | ETGTRFPNITNLCPFGEVFNATRFASVYAWNRKRISNCVADYSVLYNSASFSTFKCYGV<br>SPTKLNDLCFTNVYADSFVIRGDEVRQIAPGQTGKIADYNYKLPDDFTGCVIAWNSNNL<br>DSKVGGNYNYLYRLFRKSNLKPFERDISTEIYQAGSTPCNGVEGFNCYFPLQSYGFQPT<br>NGVGYQPYRVVVLSFELLHAPATVCGPKKSTGGSGGSGSEKAAKAEEAARMEELFKEHK<br>IVAVLRANSVEEAKKKALAVFLGGVDLIEITFTVPDADTVIKELSFLKEMGAIIGAGTV<br>TSVEQAREAVESGAEFIVSPHLDEEISQFAKEEGVFYMPGVMTPTELVKAMKLGHTILK<br>LFPGEVVGPQFVEAMKGPFPNVKFVPTGGVNLDNVAEWFEAGVQAVGVGEALNEGTPVE<br>VAEKAKAFVEKIEGATE(GGSHHHHHHHH) (SEQ ID NO: 48) |
| | | RFPNITNLCPFGEVFNATRFASVYAWNRKRISNCVADYSVLYNSASFSTFKCYGVSPTK<br>LNDLCFTNVYADSFVIRGDEVRQIAPGQTGKIADYNYKLPDDFTGCVIAWNSNNLDSKV<br>GGNYNYLYRLFRKSNLKPFERDISTEIYQAGSTPCNGVEGFNCYFPLQSYGFQPTNGVG<br>YQPYRVVVLSFELLHAPATVCGPKKST(X1)MEELFKEHKIVAVLRANSVEEAKKKALA<br>VFLGGVDLIEITFTVPDADTVIKELSFLKEMGAIIGAGTVTSVEQAREAVESGAEFIVS<br>PHLDEEISQFAKEEGVFYMPGVMTPTELVKAMKLGHTILKLFPGEVVGPQFVEAMKGPF<br>PNVKFVPTGGVNLDNVAEWFEAGVQAVGVGEALNEGTPVEVAEKAKAFVEKIEGATE<br>(SEQ ID NO: 49) |
| | | (mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK |

TABLE 1-continued

| Protein name | Protein type | Expressed sequence (optional residues in parentheses; X1 is optional linker) |
|---|---|---|
| | | ST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 50) |
| | | ETGTREPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 51) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 52) |
| SARS-CoV-2 RBD-I3-01*-secOpt-12GS-he-His | SARS-CoV-2-I3-01 fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 53) |
| | | (mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 54) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 55) |
| | | ETGTRFPNITNLCPFGEVFNATREASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 56) |
| | | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPEPNVKFVPTGGVNLDNVAEWFEAGVQAVGVGEALNEGTPVEVAEKAKAFVEKIEGATE (SEQ ID NO: 57) |
| | | (mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 58) |
| | | ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAE |

TABLE 1-continued

| Protein name | Protein type | Expressed sequence (optional residues in parentheses; X1 is optional linker) |
|---|---|---|
| | | FIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 59)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 60) |
| SARS-CoV-2 RBD-I3-01*-secOpt-16GS-he-His | SARS-COV-2-I3-01 fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 61)<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSEVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 62)<br>ETGTREPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 63)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 64)<br>RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPEPNVKFVPTGGVNLDNVAEWFEAGVQAVGVGEALNEGTPVEVAEKAKAFVEKIEGATE (SEQ ID NO: 65)<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 66)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 67)<br>ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKK |

TABLE 1-continued

| Protein name | Protein type | Expressed sequence (optional residues in parentheses; X1 is optional linker) |
|---|---|---|
| | | KALAVFLGGVDLIEITFTVPDADTVIKELSFLKEMGAIIGAGTVTSVEQAREAVESGAE<br>FIVSPHLDEEISQFAKEEGVFYMPGVMTPTELVKAMKLGHTILKLFPGEVVGPQFVEAM<br>KGPFPNVKFVPTGGVNLDNVAEWFEAGVQAVGVGEALNEGTPVEVAEKAKAFVEKIEGA<br>TE(GGSHHHHHHHH) (SEQ ID NO: 68) |
| SARS-CoV-2 2PSGAG-S-TEV-FO-I3-01*-secOpt-12GS-he-His | SARS-CoV-2-I3-01 fusion protein | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS<br>VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGEIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIKgsgrenlyfqggggsgyipeaprdgqayvrkdgewvllstf<br>lgGSGSGGSGGSGSEKAAKAEEAARMEELFKEHKIVAVLRANSVEEAKKKALAVFLGGV<br>DLIEITFTVPDADTVIKELSFLKEMGAIIGAGTVTSVEQAREAVESGAEFIVSPHLDEE<br>ISQFAKEEGVFYMPGVMTPTELVKAMKLGHTILKLFPGEVVGPQFVEAMKGPFPNVKFV<br>PTGGVNLDNVAEWFEAGVQAVGVGEALNEGTPVEVAEKAKAFVEKIEGATE (SEQ ID<br>NO: 69) |
| | | (mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKLNDLCF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVLNDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH<br>TSPDVDLGDISGINASVVNIQKEIDRLNEVAKNLNESLIDLQELGKYEQYIKgsgrenl<br>yfqggggsgyipeaprdgqayvrkdgewvllstflgGSGSGGSGGSGSEKAAKAEEAAR<br>MEELFKEHKIVAVLRANSVEEAKKKALAVFLGGVDLIEITFTVPDADTVIKELSFLKEM<br>GAIIGAGTVTSVEQAREAVESGAEFIVSPHLDEEISQFAKEEGVFYMPGVMTPTELVKA<br>MKLGHTILKLFPGEVVGPQFVEAMKGPFPNVKFVPTGGVNLDNVAEWFEAGVQAVGVGE<br>ALNEGTPVEVAEKAKAFVEKIEGATE(GGSHHHHHHHH) (SEQ ID NO: 70) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV |

TABLE 1-continued

| Protein name | Protein type | Expressed sequence (optional residues in parentheses; X1 is optional linker) |
|---|---|---|
| | | AKNLNESLIDLQELGKYEQYIKgsgrenlyfqggggsgyipeaprdgqayvrkdgewvl<br>lstflgGSGSGGSGGSGSEKAAKAEEAARMEELFKEHKIVAVLRANSVEEAKKKALAVE<br>LGGVDLIEITFTVPDADTVIKELSFLKEMGAIIGAGTVTSVEQAREAVESGAEFIVSPH<br>LDEEISQFAKEEGVFYMPGVMTPTELVKAMKLGHTILKLFPGEVVGPQFVEAMKGPFPN<br>VKFVPTGGVNLDNVAEWFEAGVQAVGVGEALNEGTPVEVAEKAKAFVEKIEGATE<br>(SEQ ID NO: 71) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKgsgrenlyfqggggsgyipeaprdgqayvrkdgewvl<br>lstflgGSGSGGSGGSGSEKAAKAEEAARMEELFKEHKIVAVLRANSVEEAKKKALAVF<br>LGGVDLIEITFTVPDADTVIKELSFLKEMGAIIGAGTVTSVEQAREAVESGAEFIVSPH<br>LDEEISQFAKEEGVFYMPGVMTPTELVKAMKLGHTILKLFPGEVVGPQFVEAMKGPFPN<br>VKFVPTGGVNLDNVAEWFEAGVQAVGVGEALNEGTPVEVAEKAKAFVEKIEGATE(GGS<br>HHHHHHHH) (SEQ ID NO: 72) |
| | | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS<br>VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGFIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIKgsgrenlyfqggggsgyipeaprdgqayvrkdgewvllstf<br>lg(X1)MEELFKEHKIVAVLRANSVEEAKKKALAVFLGGVDLIEITFTVPDADTVIKEL<br>SFLKEMGAIIGAGTVTSVEQAREAVESGAEFIVSPHLDEEISQFAKEEGVFYMPGVMTP<br>TELVKAMKLGHTILKLFPGEVVGPQFVEAMKGPFPNVKFVPTGGVNLDNVAEWFEAGVQ<br>AVGVGEALNEGTPVEVAEKAKAFVEKIEGATE (SEQ ID NO: 73) |
| | | (mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTEK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKLNDICF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVINDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH |

TABLE 1-continued

| Protein name | Protein type | Expressed sequence (optional residues in parentheses; X1 is optional linker) |
|---|---|---|
| | | TSPDVDLGDISGINASVVNIQKEIDRLNEVAKNLNESLIDLQELGKYEQYIKgsgrenl<br>yfqggggsgyipeaprdgqayvrkdgewvllstflg(X1)MEELFKEHKIVAVLRANSV<br>EEAKKKALAVFLGGVDLIEITFTVPDADTVIKELSFLKEMGAIIGAGTVTSVEQAREAV<br>ESGAEFIVSPHLDEEISQFAKEEGVFYMPGVMTPTELVKAMKLGHTILKLFPGEVVGPQ<br>FVEAMKGPFPNVKFVPTGGVNLDNVAEWFEAGVQAVGVGEALNEGTPVEVAEKAKAFVE<br>KIEGATE(GGSHHHHHHHH) (SEQ ID NO: 74) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKgsgrenlyfqggggsgyipeaprdgqayvrkdgewvl<br>lstflg(X1)MEELFKEHKIVAVLRANSVEEAKKKALAVFLGGVDLIEITFTVPDADTV<br>IKELSFLKEMGAIIGAGTVTSVEQAREAVESGAEFIVSPHLDEEISQFAKEEGVFYMPG<br>VMTPTELVKAMKLGHTILKLFPGEVVGPQFVEAMKGPFPNVKFVPTGGVNLDNVAEWFE<br>AGVQAVGVGEALNEGTPVEVAEKAKAFVEKIEGATE (SEQ ID NO: 75) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKgsgrenlyfqggggsgyipeaprdgqayvrkdgewvl<br>lstflg(X1)MEELFKEHKIVAVLRANSVEEAKKKALAVFLGGVDLIEITFTVPDADTV<br>IKELSFLKEMGAIIGAGTVTSVEQAREAVESGAEFIVSPHLDEEISQFAKEEGVFYMPG<br>VMTPTELVKAMKLGHTILKLFPGEVVGPQFVEAMKGPFPNVKFVPTGGVNLDNVAEWFE<br>AGVQAVGVGEALNEGTPVEVAEKAKAFVEKIEGATE(GGSHHHHHHHH) (SEQ ID<br>NO: 76) |
| SARS-<br>COV-2<br>2PSGA<br>G-S-<br>I3-<br>01*-<br>secOp<br>t-<br>12GS-<br>he-<br>His | SARS-<br>CoV-2-<br>I3-01<br>fusion<br>protein | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS<br>VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGFIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN |

TABLE 1-continued

| Protein name | Protein type | Expressed sequence (optional residues in parentheses; X1 is optional linker) |
|---|---|---|
| | | NTVYDPLQPELDSFKEELDKYFKNHTSPDVDLGDISGINASVVNIQKEIDRLNEVAKNL<br>NESLIDLQELGKYEQYIKGSGSGGSGGSGSEKAAKAEEAARKMEELFKEHKIVAVLRAN<br>SVEEAKKKALAVFLGGVDLIEITFTVPDADTVIKELSFLKEMGAIIGAGTVTSVEQARE<br>AVESGAEFIVSPHLDEEISQFAKEEGVFYMPGVMTPTELVKAMKLGHTILKLFPGEVVG<br>PQFVEAMKGPFPNVKFVPTGGVNLDNVAEWFEAGVQAVGVGEALNEGTPVEVAEKAKAF<br>VEKIEGATE (SEQ ID NO: 77) |
| | | (mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKINDLCF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVLNDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH<br>TSPDVDLGDISGINASVVNIQKEIDRLNEVAKNLNESLIDLQELGKYEQYIKGSGSGGS<br>GGSGSEKAAKAEEAARKMEELFKEHKIVAVLRANSVEEAKKKALAVFLGGVDLIEITFT<br>VPDADTVIKELSFLKEMGAIIGAGTVTSVEQAREAVESGAEFIVSPHLDEEISQFAKEE<br>GVFYMPGVMTPTELVKAMKLGHTILKLFPGEVVGPQFVEAMKGPFPNVKFVPTGGVNLD<br>NVAEWFEAGVQAVGVGEALNEGTPVEVAEKAKAFVEKIEGATE(GGSHHHHHHHH)<br>(SEQ ID NO: 78) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIKGSGSGGSGGSGSEKAAKAEEAARKMEELFKEHKIVAV<br>LRANSVEEAKKKALAVFLGGVDLIEITFTVPDADTVIKELSFLKEMGAIIGAGTVTSVE<br>QAREAVESGAEFIVSPHLDEEISQFAKEEGVFYMPGVMTPTELVKAMKLGHTILKLFPG<br>EVVGPQFVEAMKGPFPNVKFVPTGGVNLDNVAEWFEAGVQAVGVGEALNEGTPVEVAEK<br>AKAFVEKIEGATE (SEQ ID NO: 79) |
| | | ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV |

TABLE 1-continued

| Protein name | Protein type | Expressed sequence (optional residues in parentheses; X1 is optional linker) |
|---|---|---|
| | | AKNLNESLIDLQELGKYEQYIKGSGSGGSGGSGSEKAAKAEEAARKMEELFKEHKIVAV LRANSVEEAKKKALAVFLGGVDLIEITFTVPDADTVIKELSFLKEMGAIIGAGTVTSVE QAREAVESGAEFIVSPHLDEEISQFAKEEGVFYMPGVMTPTELVKAMKLGHTILKLFPG EVVGPQFVEAMKGPFPNVKFVPTGGVNLDNVAEWFEAGVQAVGVGEALNEGTPVEVAEK AKAFVEKIEGATE(GGSHHHHHHHH) (SEQ ID NO: 80) |
| | | QCVNLTTRTQLPPAYTNSFTRGVYYPDKVFRSSVLHSTQDLFLPFFSNVTWFHAIHVSG TNGTKRFDNPVLPFNDGVYFASTFKSNIIRGWIFGTTLDSKTQSLLIVNNATNVVIKVC EFQFCNDPFLGVYYHKNNKSWMESEFRVYSSANNCTFEYVSQPFLMDLEGKQGNFKNLR EFVFKNIDGYFKIYSKHTPINLVRDLPQGFSALEPLVDLPIGINITRFQTLLALHRSYL TPGDSSSGWTAGAAAYYVGYLQPRTFLLKYNENGTITDAVDCALDPLSETKCTLKSFTV EKGIYQTSNFRVQPTESIVRFPNITNLCPFGEVFNATRFASVYAWNRKRISNCVADYSV LYNSASFSTFKCYGVSPTKLNDLCFTNVYADSFVIRGDEVRQIAPGQTGKIADYNYKLP DDFTGCVIAWNSNNLDSKVGGNYNYLYRLFRKSNLKPFERDISTEIYQAGSTPCNGVEG FNCYFPLQSYGFQPTNGVGYQPYRVVVLSFELLHAPATVCGPKKSTNLVKNKCVNFNFN GLTGTGVLTESNKKFLPFQQFGRDIADTTDAVRDPQTLEILDITPCSFGGVSVITPGTN TSNQVAVLYQDVNCTEVPVAIHADQLTPTWRVYSTGSNVFQTRAGCLIGAEHVNNSYEC DIPIGAGICASYQTQTNSPSGAGSVASQSIIAYTMSLGAENSVAYSNNSIAIPTNFTIS VTTEILPVSMTKTSVDCTMYICGDSTECSNLLLQYGSFCTQLNRALTGIAVEQDKNTQE VFAQVKQIYKTPPIKDFGGFNFSQILPDPSKPSKRSFIEDLLFNKVTLADAGFIKQYGD CLGDIAARDLICAQKFNGLTVLPPLLTDEMIAQYTSALLAGTITSGWTFGAGAALQIPF AMQMAYRFNGIGVTQNVLYENQKLIANQFNSAIGKIQDSLSSTASALGKLQDVVNQNAQ ALNTLVKQLSSNFGAISSVLNDILSRLDPPEAEVQIDRLITGRLQSLQTYVTQQLIRAA EIRASANLAATKMSECVLGQSKRVDFCGKGYHLMSFPQSAPHGVVFLHVTYVPAQEKNF TTAPAICHDGKAHFPREGVFVSNGTHWFVTQRNFYEPQIITTDNTFVSGNCDVVIGIVN NTVYDPLQPELDSFKEELDKYFKNHTSPDVDLGDISGINASVVNIQKEIDRLNEVAKNL NESLIDLQELGKYEQYIK(X1)MEELFKEHKIVAVLRANSVEEAKKKALAVFLGGVDLI EITFTVPDADTVIKELSFLKEMGAIIGAGTVTSVEQAREAVESGAEFIVSPHLDEEISQ FAKEEGVFYMPGVMTPTELVKAMKLGHTILKLFPGEVVGPQFVEAMKGPFPNVKFVPTG GVNLDNVAEWFEAGVQAVGVGEALNEGTPVEVAEKAKAFVEKIEGATE (SEQ ID NO: 81) |
| | | (mgilpspgmpallslvsllsvllmgcvaetgt)QCVNLTTRTQLPPAYTNSFTRGVYY PDKVFRSSVLHSTQDLFLPFFSNVTWFHAIHVSGTNGTKRFDNPVLPFNDGVYFASTFK SNIIRGWIFGTTLDSKTQSLLIVNNATNVVIKVCEFQFCNDPFLGVYYHKNNKSWMESE FRVYSSANNCTFEYVSQPFLMDLEGKQGNFKNLREFVFKNIDGYFKIYSKHTPINLVRD LPQGFSALEPLVDLPIGINITRFQTLLALHRSYLTPGDSSSGWTAGAAAYYVGYLQPRT FLLKYNENGTITDAVDCALDPLSETKCTLKSFTVEKGIYQTSNFRVQPTESIVRFPNIT NLCPFGEVFNATRFASVYAWNRKRISNCVADYSVLYNSASFSTFKCYGVSPTKLNDLCE TNVYADSFVIRGDEVRQIAPGQTGKIADYNYKLPDDFTGCVIAWNSNNLDSKVGGNYNY LYRLFRKSNLKPFERDISTEIYQAGSTPCNGVEGFNCYFPLQSYGFQPTNGVGYQPYRV VVLSFELLHAPATVCGPKKSTNLVKNKCVNFNFNGLTGTGVLTESNKKFLPFQQFGRDI ADTTDAVRDPQTLEILDITPCSFGGVSVITPGTNTSNQVAVLYQDVNCTEVPVAIHADQ LTPTWRVYSTGSNVFQTRAGCLIGAEHVNNSYECDIPIGAGICASYQTQTNSPSGAGSV ASQSIIAYTMSLGAENSVAYSNNSIAIPTNFTISVTTEILPVSMTKTSVDCTMYICGDS TECSNLLLQYGSFCTQLNRALTGIAVEQDKNTQEVFAQVKQIYKTPPIKDFGGFNFSQI LPDPSKPSKRSFIEDLLFNKVTLADAGFIKQYGDCLGDIAARDLICAQKFNGLTVLPPL LTDEMIAQYTSALLAGTITSGWTFGAGAALQIPFAMQMAYRFNGIGVTQNVLYENQKLI ANQFNSAIGKIQDSLSSTASALGKLQDVVNQNAQALNTLVKQLSSNFGAISSVLNDILS RLDPPEAEVQIDRLITGRLQSLQTYVTQQLIRAAEIRASANLAATKMSECVLGQSKRVD FCGKGYHLMSFPQSAPHGVVFLHVTYVPAQEKNFTTAPAICHDGKAHFPREGVEVSNGT HWFVTQRNFYEPQIITTDNTFVSGNCDVVIGIVNNTVYDPLQPELDSFKEELDKYFKNH TSPDVDLGDISGINASVVNIQKEIDRLNEVAKNLNESLIDLQELGKYEQYIK(X1)MEE LFKEHKIVAVLRANSVEEAKKKALAVFLGGVDLIEITFTVPDADTVIKELSFLKEMGAI IGAGTVTSVEQAREAVESGAEFIVSPHLDEEISQFAKEEGVFYMPGVMTPTELVKAMKL GHTILKLFPGEVVGPQFVEAMKGPFPNVKFVPTGGVNLDNVAEWFEAGVQAVGVGEALN EGTPVEVAEKAKAFVEKIEGATE(GGSHHHHHHHH) (SEQ ID NO: 82) |
| | | ETGTQCVNLTTRTQLPPAYTNSFTRGVYYPDKVFRSSVLHSTQDLFLPFFSNVTWFHAI HVSGTNGTKRFDNPVLPFNDGVYFASTFKSNIIRGWIFGTTLDSKTQSLLIVNNATNVV IKVCEFQFCNDPFLGVYYHKNNKSWMESEFRVYSSANNCTFEYVSQPFLMDLEGKQGNF KNLREFVFKNIDGYFKIYSKHTPINLVRDLPQGFSALEPLVDLPIGINITRFQTLLALH RSYLTPGDSSSGWTAGAAAYYVGYLQPRTFLLKYNENGTITDAVDCALDPLSETKCTLK SFTVEKGIYQTSNFRVQPTESIVRFPNITNLCPFGEVFNATRFASVYAWNRKRISNCVA DYSVLYNSASFSTFKCYGVSPTKLNDLCFTNVYADSFVIRGDEVRQIAPGQTGKIADYN YKLPDDFTGCVIAWNSNNLDSKVGGNYNYLYRLFRKSNLKPFERDISTEIYQAGSTPCN GVEGFNCYFPLQSYGFQPTNGVGYQPYRVVVLSFELLHAPATVCGPKKSTNLVKNKCVN FNFNGLTGTGVLTESNKKFLPFQQFGRDIADTTDAVRDPQTLEILDITPCSFGGVSVIT PGTNTSNQVAVLYQDVNCTEVPVAIHADQLTPTWRVYSTGSNVFQTRAGCLIGAEHVNN SYECDIPIGAGICASYQTQTNSPSGAGSVASQSIIAYTMSLGAENSVAYSNNSIAIPTN FTISVTTEILPVSMTKTSVDCTMYICGDSTECSNLLLQYGSFCTQLNRALTGIAVEQDK NTQEVFAQVKQIYKTPPIKDFGGFNFSQILPDPSKPSKRSFIEDLLFNKVTLADAGFIK QYGDCLGDIAARDLICAQKFNGLTVLPPLLTDEMIAQYTSALLAGTITSGWTFGAGAAL QIPFAMQMAYRFNGIGVTQNVLYENQKLIANQFNSAIGKIQDSLSSTASALGKLQDVVN QNAQALNTLVKQLSSNFGAISSVLNDILSRLDPPEAEVQIDRLITGRLQSLQTYVTQQL IRAAEIRASANLAATKMSECVLGQSKRVDFCGKGYHLMSFPQSAPHGVVFLHVTYVPAQ EKNFTTAPAICHDGKAHFPREGVFVSNGTHWFVTQRNFYEPQIITTDNTFVSGNCDVVI GIVNNTVYDPLQPELDSFKEELDKYFKNHTSPDVDLGDISGINASVVNIQKEIDRLNEV AKNLNESLIDLQELGKYEQYIK(X1)MEELFKEHKIVAVLRANSVEEAKKKALAVFLGG VDLIEITFTVPDADTVIKELSFLKEMGAIIGAGTVTSVEQAREAVESGAEFIVSPHLDE |

TABLE 1-continued

| Protein name | Protein type | Expressed sequence (optional residues in parentheses; X1 is optional linker) |
|---|---|---|
| | | EISQFAKEEGVFYMPGVMTPTELVKAMKLGHTILKLFPGEVVGPQFVEAMKGPFPNVKF<br>VPTGGVNLDNVAEWFEAGVQAVGVGEALNEGTPVEVAEKAKAFVEKIEGATE (SEQ<br>ID NO: 83)<br>ETGTQCVNLTTRTQLPPAYTNSFTRGVYYPDKVFRSSVLHSTQDLFLPFFSNVTWFHAI<br>HVSGTNGTKRFDNPVLPFNDGVYFASTFKSNIIRGWIFGTTLDSKTQSLLIVNNATNVV<br>IKVCEFQFCNDPFLGVYYHKNNKSWMESEFRVYSSANNCTFEYVSQPFLMDLEGKQGNF<br>KNLREFVFKNIDGYFKIYSKHTPINLVRDLPQGFSALEPLVDLPIGINITRFQTLLALH<br>RSYLTPGDSSSGWTAGAAAYYVGYLQPRTFLLKYNENGTITDAVDCALDPLSETKCTLK<br>SFTVEKGIYQTSNFRVQPTESIVRFPNITNLCPFGEVFNATRFASVYAWNRKRISNCVA<br>DYSVLYNSASFSTFKCYGVSPTKLNDLCFTNVYADSFVIRGDEVRQIAPGQTGKIADYN<br>YKLPDDFTGCVIAWNSNNLDSKVGGNYNYLYRLFRKSNLKPFERDISTEIYQAGSTPCN<br>GVEGFNCYFPLQSYGFQPTNGVGYQPYRVVVLSFELLHAPATVCGPKKSTNLVKNKCVN<br>FNFNGLTGTGVLTESNKKFLPFQQFGRDIADTTDAVRDPQTLEILDITPCSFGGVSVIT<br>PGTNTSNQVAVLYQDVNCTEVPVAIHADQLTPTWRVYSTGSNVFQTRAGCLIGAEHVNN<br>SYECDIPIGAGICASYQTQTNSPSGAGSVASQSIIAYTMSLGAENSVAYSNNSIAIPTN<br>FTISVTTEILPVSMTKTSVDCTMYICGDSTECSNLLLQYGSFCTQLNRALTGIAVEQDK<br>NTQEVFAQVKQIYKTPPIKDFGGFNFSQILPDPSKPSKRSFIEDLLFNKVTLADAGFIK<br>QYGDCLGDIAARDLICAQKFNGLTVLPPLLTDEMIAQYTSALLAGTITSGWTFGAGAAL<br>QIPFAMQMAYRFNGIGVTQNVLYENQKLIANQFNSAIGKIQDSLSSTASALGKLQDVVN<br>QNAQALNTLVKQLSSNFGAISSVLNDILSRLDPPEAEVQIDRLITGRLQSLQTYVTQQL<br>IRAAEIRASANLAATKMSECVLGQSKRVDFCGKGYHLMSFPQSAPHGVVFLHVTYVPAQ<br>EKNFTTAPAICHDGKAHFPREGVFVSNGTHWFVTQRNFYEPQIITTDNTFVSGNCDVVI<br>GIVNNTVYDPLQPELDSFKEELDKYFKNHTSPDVDLGDISGINASVVNIQKEIDRLNEV<br>AKNLNESLIDLQELGKYEQYIK(X1)MEELFKEHKIVAVLRANSVEEAKKKALAVFLGG<br>VDLIEITFTVPDADTVIKELSFLKEMGAIIGAGTVTSVEQAREAVESGAEFIVSPHLDE<br>EISQFAKEEGVFYMPGVMTPTELVKAMKLGHTILKLFPGEVVGPQFVEAMKGPFPNVKF<br>VPTGGVNLDNVAEWFEAGVQAVGVGEALNEGTPVEVAEKAKAFVEKIEGATE(GGSHHH<br>HHHHH) (SEQ ID NO: 84) |
| SARS-<br>CoV-2<br>RBD-<br>I53-<br>50A*-<br>12GS-<br>he-<br>His | SARS-<br>CoV-2-<br>I53-50A<br>fusion<br>protein | RFPNITNLCPFGEVFNATRFASVYAWNRKRISNCVADYSVLYNSASFSTFKCYGVSPTK<br>LNDLCFTNVYADSFVIRGDEVRQIAPGQTGKIADYNYKLPDDFTGCVIAWNSNNLDSKV<br>GGNYNYLYRLFRKSNLKPFERDISTEIYQAGSTPCNGVEGFNCYFPLQSYGFQPTNGVG<br>YQPYRVVVLSFELLHAPATVCGPKKST(X1)KMEELFKKHKIVAVLRANSVEEAIEKAV<br>AVFAGGVHLIEITFTVPDADTVIKALSVLKEKGAIIGAGTVTSVEQARKAVESGAEFIV<br>SPHLDEEISQFAKEKGVFYMPGVMTPTELVKAMKLGHTILKLFPGEVVGPQFVKAMKGP<br>FPNVKFVPTGGVNLDNVAEWFKAGVLAVGVGSALVKGTPDEVREKAKAFVEKIRGATE<br>SEQ ID NO: 167<br>(mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>ST(GSGSGGSGGSGSEKAAKAEEAAR)KMEELFKKHKIVAVLRANSVEEAIEKAVAVFA<br>GGVHLIEITFTVPDADTVIKALSVLKEKGAIIGAGTVTSVEQARKAVESGAEFIVSPHL<br>DEEISQFAKEKGVFYMPGVMTPTELVKAMKLGHTILKLFPGEVVGPQFVKAMKGPFPNV<br>KFVPTGGVNLDNVAEWFKAGVLAVGVGSALVKGTPDEVREKAKAFVEKIRGATE(GGSH<br>HHHHHHH) SEQ ID NO: 168 |
| SARS-<br>CoV-2<br>RBD-<br>I53-<br>50A*-<br>16GS-<br>he-<br>His | SARS-<br>CoV-2-<br>I53-50A<br>fusion<br>protein | RFPNITNLCPFGEVFNATRFASVYAWNRKRISNCVADYSVLYNSASFSTFKCYGVSPTK<br>LNDLCFTNVYADSFVIRGDEVRQIAPGQTGKIADYNYKLPDDFTGCVIAWNSNNLDSKV<br>GGNYNYLYRLFRKSNLKPFERDISTEIYQAGSTPCNGVEGFNCYFPLQSYGFQPTNGVG<br>YQPYRVVVLSFELLHAPATVCGPKKST(X1)KMEELFKKHKIVAVLRANSVEEAIEKAV<br>AVFAGGVHLIEITFTVPDADTVIKALSVLKEKGAIIGAGTVTSVEQARKAVESGAEFIV<br>SPHLDEEISQFAKEKGVFYMPGVMTPTELVKAMKLGHTILKLFPGEVVGPQFVKAMKGP<br>FPNVKFVPTGGVNLDNVAEWEKAGVLAVGVGSALVKGTPDEVREKAKAFVEKIRGATE<br>SEQ ID NO: 169<br>(mgilpspgmpallslvsllsvllmgcvaetgt)RFPNITNLCPFGEVFNATRFASVYA<br>WNRKRISNCVADYSVLYNSASFSTFKCYGVSPTKLNDLCFTNVYADSFVIRGDEVRQIA<br>PGQTGKIADYNYKLPDDFTGCVIAWNSNNLDSKVGGNYNYLYRLFRKSNLKPFERDIST<br>EIYQAGSTPCNGVEGFNCYFPLQSYGFQPTNGVGYQPYRVVVLSFELLHAPATVCGPKK<br>ST(GGSGGSGSGGSGGSGSEKAAKAEEAAR)KMEELFKKHKIVAVLRANSVEEAIEKAV<br>AVFAGGVHLIEITFTVPDADTVIKALSVLKEKGAIIGAGTVTSVEQARKAVESGAEFIV<br>SPHLDEEISQFAKEKGVFYMPGVMTPTELVKAMKLGHTILKLFPGEVVGPQFVKAMKGP<br>FPNVKFVPTGGVNLDNVAEWFKAGVLAVGVGSALVKGTPDEVREKAKAFVEKIRGATE<br>(GGSHHHHHHHH) SEQ ID NO: 170 |
| SARS-<br>CoV-2<br>2PSGA<br>G-S-<br>TEV-<br>FO-<br>I53-<br>50A*-<br>12GS-<br>he-<br>His | SARS-<br>CoV-2-<br>I53-50A<br>fusion<br>protein | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS |

TABLE 1-continued

| Protein name | Protein type | Expressed sequence (optional residues in parentheses; X1 is optional linker) |
|---|---|---|
| | | VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGFIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIK(X1)KMEELFKKHKIVAVLRANSVEEAIEKAVAVFAGGVHL<br>IEITFTVPDADTVIKALSVLKEKGAIIGAGTVTSVEQARKAVESGAEFIVSPHLDEEIS<br>QFAKEKGVFYMPGVMTPTELVKAMKLGHTILKLFPGEVVGPQFVKAMKGPFPNVKFVPT<br>GGVNLDNVAEWFKAGVLAVGVGSALVKGTPDEVREKAKAFVEKIRGATE SEQ ID<br>NO: 171<br>(mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKREDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKLNDLCE<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVLNDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH<br>TSPDVDLGDISGINASVVNIQKEIDRLNEVAKNLNESLIDLQELGKYEQYIK(gsgren<br>lyfqgggggsgyipeaprdgqayvrkdgewvllstflgGSGSGGSGGSGSEKAAKAEEAA<br>R)KMEELFKKHKIVAVLRANSVEEAIEKAVAVFAGGVHLIEITFTVPDADTVIKALSVL<br>KEKGAIIGAGTVTSVEQARKAVESGAEFIVSPHLDEEISQFAKEKGVFYMPGVMTPTEL<br>VKAMKLGHTILKLFPGEVVGPQFVKAMKGPFPNVKFVPTGGVNLDNVAEWFKAGVLAVG<br>VGSALVKGTPDEVREKAKAFVEKIRGATE(GGSHHHHHHHH) SEQ ID NO: 172 |
| SARS-CoV-2 2PSGA G-S-I53-50A*-12GS-he-His | SARS-CoV-2-I53-50A fusion protein | QCVNLTTRTQLPPAYTNSFTRGVYYPDKVFRSSVLHSTQDLFLPFFSNVTWFHAIHVSG<br>TNGTKRFDNPVLPFNDGVYFASTFKSNIIRGWIFGTTLDSKTQSLLIVNNATNVVIKVC<br>EFQFCNDPFLGVYYHKNNKSWMESEFRVYSSANNCTFEYVSQPFLMDLEGKQGNFKNLR<br>EFVFKNIDGYFKIYSKHTPINLVRDLPQGFSALEPLVDLPIGINITRFQTLLALHRSYL<br>TPGDSSSGWTAGAAAYYVGYLQPRTFLLKYNENGTITDAVDCALDPLSETKCTLKSFTV<br>EKGIYQTSNFRVQPTESIVRFPNITNLCPFGEVFNATRFASVYAWNRKRISNCVADYSV<br>LYNSASFSTFKCYGVSPTKLNDLCFTNVYADSFVIRGDEVRQIAPGQTGKIADYNYKLP<br>DDFTGCVIAWNSNNLDSKVGGNYNYLYRLFRKSNLKPFERDISTEIYQAGSTPCNGVEG<br>FNCYFPLQSYGFQPTNGVGYQPYRVVVLSFELLHAPATVCGPKKSTNLVKNKCVNFNFN<br>GLTGTGVLTESNKKFLPFQQFGRDIADTTDAVRDPQTLEILDITPCSFGGVSVITPGTN<br>TSNQVAVLYQDVNCTEVPVAIHADQLTPTWRVYSTGSNVFQTRAGCLIGAEHVNNSYEC<br>DIPIGAGICASYQTQTNSPSGAGSVASQSIIAYTMSLGAENSVAYSNNSIAIPTNFTIS<br>VTTEILPVSMTKTSVDCTMYICGDSTECSNLLLQYGSFCTQLNRALTGIAVEQDKNTQE<br>VFAQVKQIYKTPPIKDFGGFNFSQILPDPSKPSKRSFIEDLLFNKVTLADAGFIKQYGD<br>CLGDIAARDLICAQKFNGLTVLPPLLTDEMIAQYTSALLAGTITSGWTFGAGAALQIPF<br>AMQMAYRFNGIGVTQNVLYENQKLIANQFNSAIGKIQDSLSSTASALGKLQDVVNQNAQ<br>ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIK(X1)KMEELFKKHKIVAVLRANSVEEAIEKAVAVFAGGVHL<br>IEITFTVPDADTVIKALSVLKEKGAIIGAGTVTSVEQARKAVESGAEFIVSPHLDEEIS<br>QFAKEKGVFYMPGVMTPTELVKAMKLGHTILKLFPGEVVGPQFVKAMKGPFPNVKFVPT<br>GGVNLDNVAEWFKAGVLAVGVGSALVKGTPDEVREKAKAFVEKIRGATE SEQ ID<br>NO: 173<br>(mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKINDLCF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV |

TABLE 1-continued

| Protein name | Protein type | Expressed sequence (optional residues in parentheses; X1 is optional linker) |
|---|---|---|
| | | ASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK(GSGSGGSGGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) SEQ ID NO: 174 |
| SARS-CoV-2 RBD-I3-01*-secOpt-8GS-he-His | SARS-CoV-2-I3-01 fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE SEQ ID NO: 175<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(GGSGGSGSEKAAKAEEAAR)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) SEQ ID NO: 176 |
| SARS-CoV-2 RBD-I3-01*-secOpt-12GS-he-His | SARS-CoV-2-I3-01 fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE SEQ ID NO: 177<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(GSGSGGSGGSGSEKAAKAEEAAR)MEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) SEQ ID NO: 178 |
| SARS-CoV-2 RBD-I3-01*-secOpt-16GS-he-His | SARS-CoV-2-I3-01 fusion protein | RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE SEQ ID NO: 179<br>(mgilpspgmpallslvsllsvllmgcvaetgt)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST(GGSGGSGSGGSGGSGSEKAAKAEEAAR)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) SEQ ID NO: 180 |

TABLE 1-continued

| Protein name | Protein type | Expressed sequence (optional residues in parentheses; X1 is optional linker) |
|---|---|---|
| SARS-CoV-2 2PSGAG-S-TEV-FO-I3-01*-secopt-12GS-he-His | SARS-CoV-2-I3-01 fusion protein | QCVNLTTRTQLPPAYTNSFTRGVYYPDKVFRSSVLHSTQDLFLPFFSNVTWFHAIHVSGTNGTKRFDNPVLPFNDGVYFASTFKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK(X1)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE SEQ ID NO: 181<br>(mgilpspgmpallslvsllsvllmgcvaetgt)QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK(gsgrenlyfqggggsgyipeaprdgqayvrkdgewvllstflgGSGSGGSGGSGSEKAAKAEEAAR)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) SEQ ID NO: 182 |
| SARS-CoV-2 2PSGAG-S-I3-01*-secOpt-12GS-he-His | SARS-CoV-2-I3-01 fusion protein | QCVNLTTRTQLPPAYTNSFTRGVYYPDKVFRSSVLHSTQDLFLPFFSNVTWFHAIHVSGTNGTKRFDNPVLPFNDGVYFASTFKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPEAMQMAYRFNGIGVTQNVLYENQKLIANQFNSAIGKIQDSLSSTASALGKLQDVVNQNAQ |

TABLE 1-continued

| Protein name | Protein type | Expressed sequence (optional residues in parentheses; X1 is optional linker) |
| --- | --- | --- |
| | | ALNTLVKQLSSNFGAISSVLNDILSRLDPPEAEVQIDRLITGRLQSLQTYVTQQLIRAA<br>EIRASANLAATKMSECVLGQSKRVDFCGKGYHLMSFPQSAPHGVVFLHVTYVPAQEKNF<br>TTAPAICHDGKAHFPREGVFVSNGTHWFVTQRNFYEPQIITTDNTFVSGNCDVVIGIVN<br>NTVYDPLQPELDSFKEELDKYFKNHTSPDVDLGDISGINASVVNIQKEIDRLNEVAKNL<br>NESLIDLQELGKYEQYIK(X1)MEELFKEHKIVAVLRANSVEEAKKKALAVFLGGVDLI<br>EITFTVPDADTVIKELSFLKEMGAIIGAGTVTSVEQAREAVESGAEFIVSPHLDEEISQ<br>FAKEEGVFYMPGVMTPTELVKAMKLGHTILKLFPGEVVGPQFVEAMKGPFPNVKFVPTG<br>GVNLDNVAEWFEAGVQAVGVGEALNEGTPVEVAEKAKAFVEKIEGATE SEQ ID<br>NO: 183 |
| | | (mgilpspgmpallslvsllsvllmgcvaetgt)QCVNLTTRTQLPPAYTNSFTRGVYY<br>PDKVFRSSVLHSTQDLFLPFFSNVTWFHAIHVSGTNGTKRFDNPVLPFNDGVYFASTFK<br>SNIIRGWIFGTTLDSKTQSLLIVNNATNVVIKVCEFQFCNDPFLGVYYHKNNKSWMESE<br>FRVYSSANNCTFEYVSQPFLMDLEGKQGNFKNLREFVFKNIDGYFKIYSKHTPINLVRD<br>LPQGFSALEPLVDLPIGINITRFQTLLALHRSYLTPGDSSSGWTAGAAAYYVGYLQPRT<br>FLLKYNENGTITDAVDCALDPLSETKCTLKSFTVEKGIYQTSNFRVQPTESIVRFPNIT<br>NLCPFGEVFNATRFASVYAWNRKRISNCVADYSVLYNSASFSTFKCYGVSPTKLNDLCF<br>TNVYADSFVIRGDEVRQIAPGQTGKIADYNYKLPDDFTGCVIAWNSNNLDSKVGGNYNY<br>LYRLFRKSNLKPFERDISTEIYQAGSTPCNGVEGFNCYFPLQSYGFQPTNGVGYQPYRV<br>VVLSFELLHAPATVCGPKKSTNLVKNKCVNFNFNGLTGTGVLTESNKKFLPFQQFGRDI<br>ADTTDAVRDPQTLEILDITPCSFGGVSVITPGTNTSNQVAVLYQDVNCTEVPVAIHADQ<br>LTPTWRVYSTGSNVFQTRAGCLIGAEHVNNSYECDIPIGAGICASYQTQTNSPSGAGSV<br>ASQSIIAYTMSLGAENSVAYSNNSIAIPTNFTISVTTEILPVSMTKTSVDCTMYICGDS<br>TECSNLLLQYGSFCTQLNRALTGIAVEQDKNTQEVFAQVKQIYKTPPIKDFGGFNFSQI<br>LPDPSKPSKRSFIEDLLFNKVTLADAGFIKQYGDCLGDIAARDLICAQKFNGLTVLPPL<br>LTDEMIAQYTSALLAGTITSGWTFGAGAALQIPFAMQMAYRFNGIGVTQNVLYENQKLI<br>ANQFNSAIGKIQDSLSSTASALGKLQDVVNQNAQALNTLVKQLSSNFGAISSVLNDILS<br>RLDPPEAEVQIDRLITGRLQSLQTYVTQQLIRAAEIRASANLAATKMSECVLGQSKRVD<br>FCGKGYHLMSFPQSAPHGVVFLHVTYVPAQEKNFTTAPAICHDGKAHFPREGVFVSNGT<br>HWFVTQRNFYEPQIITTDNTFVSGNCDVVIGIVNNTVYDPLQPELDSFKEELDKYFKNH<br>TSPDVDLGDISGINASVVNIQKEIDRLNEVAKNLNESLIDLQELGKYEQYIK(GSGSGG<br>SGGSGSEKAAKAEEAAR)MEELFKEHKIVAVLRANSVEEAKKKALAVFLGGVDLIEITE<br>TVPDADTVIKELSFLKEMGAIIGAGTVTSVEQAREAVESGAEFIVSPHLDEEISQFAKE<br>EGVFYMPGVMTPTELVKAMKLGHTILKLFPGEVVGPQFVEAMKGPFPNVKFVPTGGVNL<br>DNVAEWFEAGVQAVGVGEALNEGTPVEVAEKAKAFVEKIEGATE(GGSHHHHHHHH)<br>SEQ ID NO: 184 |

>HexaPro-12GS-He-I5350A*-His:
(MFVFLVLLPLVSSQC)VNLTTRTQLPPAYTNSFTRGVYYPDKVFRSSVLHSTQDLFLPFFSNVTWFHAIHVSGT
NGTKRFDNPVLPFNDGVYFASTFKSNIIRGWIFGTTLDSKTQSLLIVNNATNVVIKVCEFQFCNDPFLGVYYHKN
NKSWMESEFRVYSSANNCTFEYVSQPFLMDLEGKQGNFKNLREFVFKNIDGYFKIYSKHTPINLVRDLPQGFSAL
EPLVDLPIGINITRFQTLLALHRSYLTPGDSSSGWTAGAAAYYVGYLQPRTFLLKYNENGTITDAVDCALDPLSE
TKCTLKSFTVEKGIYQTSNFRVQPTESIVRFPNITNLCPFGEVFNATRFASVYAWNRKRISNCVADYSVLYNSAS
FSTFKCYGVSPTKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVVLSFELLHAPAT
VCGPKKSTNLVKNKCVNFNFNGLTGTGVLTESNKKFLPFQQFGRDIADTTDAVRDPQTLEILDITPCSFGGVSVI
TPGTNTSNQVAVLYQDVNCTEVPVAIHADQLTPTWRVYSTGSNVFQTRAGCLIGAEHVNNSYECDIPIGAGICAS
YQTQTNSPGSASSVASQSIIAYTMSLGAENSVAYSNNSIAIPTNFTISVTTEILPVSMTKTSVDCTMYICGDSTE
CSNLLLQYGSFCTQLNRALTGIAVEQDKNTQEVFAQVKQIYKTPPIKDFGGFNFSQILPDPSKPSKRSPIEDLLF
NKVTLADAGFIKQYGDCLGDIAARDLICAQKFNGLTVLPPLLTDEMIAQYTSALLAGTITSGWTFGAGPALQIPF
PMQMAYRFNGIGVTQNVLYENQKLIANQFNSAIGKIQDSLSSTPSALGKLQDVVNQNAQALNTLVKQLSSNFGAI
SSVLNDILSRLDPPEAEVQIDRLITGRLQSLQTYVTQQLIRAAEIRASANLAATKMSECVLGQSKRVDFCGKGYH
LMSFPQSAPHGVVFLHVTYVPAQEKNFTTAPAICHDGKAHFPREGVFVSNGTHWFVTQRNFYEPQIITTDNTFVS
GNCDVVIGIVNNTVYDPLQPELDSFKEELDKYFKNHTSPDVDLGDISGINASVVNIQKEIDRLNEVAKNLNESLI
DLQELGKYEQ(GSGSGGSGGSGSEKAAKAEEAAR)KMEELFKKHKIVAVLRANSVEEAIEKAVAVFAGGVHLIEI
TFTVPDADTVIKALSVLKEKGAIIGAGTVTSVEQARKAVESGAEFIVSPHLDEEISQFAKEKGVFYMPGVMTPTE
LVKAMKLGHTILKLFPGEVVGPQFVKAMKGPFPNVKFVPTGGVNLDNVAEWFKAGVLAVGVGSALVKGTPDEVRE
KAKAFVEKIRGATE(GGSHHHHHHHH) (SEQ ID NO: 138)

>HexaPro-FO-12GS-He-I5350A*-His:
(MFVFLVLLPLVSSQC)VNLTTRTQLPPAYTNSFTRGVYYPDKVFRSSVLHSTQDLFLPFFSNVTWFHAIHVSGT
NGTKRFDNPVLPFNDGVYFASTEKSNIIRGWIFGTTLDSKTQSLLIVNNATNVVIKVCEFQFCNDPFLGVYYHKN
NKSWMESEFRVYSSANNCTFEYVSQPFLMDLEGKQGNFKNLREFVFKNIDGYFKIYSKHTPINLVRDLPQGFSAL
EPLVDLPIGINITRFQTLLALHRSYLTPGDSSSGWTAGAAAYYVGYLQPRTFLLKYNENGTITDAVDCALDPLSE
TKCTLKSFTVEKGIYQTSNFRVQPTESIVRFPNITNLCPFGEVFNATRFASVYAWNRKRISNCVADYSVLYNSAS
FSTFKCYGVSPTKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVVLSFELLHAPAT
VCGPKKSTNLVKNKCVNFNFNGLTGTGVLTESNKKFLPFQQFGRDIADTTDAVRDPQTLEILDITPCSFGGVSVI
TPGTNTSNQVAVLYQDVNCTEVPVAIHADQLTPTWRVYSTGSNVFQTRAGCLIGAEHVNNSYECDIPIGAGICAS
YQTQTNSPGSASSVASQSIIAYTMSLGAENSVAYSNNSIAIPTNFTISVTTEILPVSMTKTSVDCTMYICGDSTE
CSNLLLQYGSFCTQLNRALTGIAVEQDKNTQEVFAQVKQIYKTPPIKDFGGFNFSQILPDPSKPSKRSPIEDLLF
NKVTLADAGFIKQYGDCLGDIAARDLICAQKFNGLTVLPPLLTDEMIAQYTSALLAGTITSGWTFGAGPALQIPF
PMQMAYRFNGIGVTQNVLYENQKLIANQFNSAIGKIQDSLSSTPSALGKLQDVVNQNAQALNTLVKQLSSNFGAI
SSVLNDILSRLDPPEAEVQIDRLITGRLQSLQTYVTQQLIRAAEIRASANLAATKMSECVLGQSKRVDFCGKGYH
LMSFPQSAPHGVVFLHVTYVPAQEKNFTTAPAICHDGKAHFPREGVFVSNGTHWFVTQRNFYEPQIITTDNTFVS
GNCDVVIGIVNNTVYDPLQPELDSFKEELDKYFKNHTSPDVDLGDISGINASVVNIQKEIDRLNEVAKNLNESLI TABLE 1-continued

| Protein name | Protein type | Expressed sequence (optional residues in parentheses; X1 is optional linker) |
|---|---|---|

DLQELGKYEQ(GS)(GYIPEAPRDGQAYVRKDGEWVLLSTFL)(GSGSGGSGGSGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 139)

>HexaPro-delHR2-12GS-He-I5350A*-His:
(MFVFLVLLPLVSS)QC)VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT(GSGSGGSGGSGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 140)

>HexaPro-delHR2-FO-12GS-He-I5350A*-His:
(MFVFLVLLPLVSS)QC)VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT(GS)(GYIPEAPRDGQAYVRKDGEWVLLSTFL)(GSGSGGSGGSGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 141)

RBD-noRpk-50A Variants
>SARS-COV-2 RBD_N501Y_16GS-he-I53-50A*-His (UK):
(MGILPSPGMPALLSLVSLLSVLLMGCVAETGT)RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKST(GGSGGSGSGGSGGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHH) (SEQ ID NO: 142)

>SARS-COV-2 RBD_K417N_E484K_N501Y_16GS-he-I53-50A*-His (S.Africa)
(MGILPSPGMPALLSLVSLLSVLLMGCVAETGT)RFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKST(GGSGGSGSGGSGGSGSEKAAKAEEAAR)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHH) (SEQ ID NO: 143)

>SARS-COV-2_RBD-noRpk_16GS_I53-50A*_Brazil-ver_K417T_E484K_N501Y (Brazil):
(MGILPSPGMPALLSLVSLLSVLLMGCVAETGT)RFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKST(GGSGGSGSGGSGGSGSEKAAKAEEAAR)KMEELFKKHKIVAVLRANSVEEAIEKAVAVFAGGVHLIEITFTVPDADTVIKALSVLKEKGAIIGAGTVTSVE TABLE 1-continued

| Protein name | Protein type | Expressed sequence (optional residues in parentheses; X1 is optional linker) |
|---|---|---|

QARKAVESGAEFIVSPHLDEEISQFAKEKGVFYMPGVMTPTELVKAMKLGHTILKLFPGEVVGPQFVK
AMKGPFPNVKFVPTGGVNLDNVAEWFKAGVLAVGVGSALVKGTPDEVREKAKAFVEKIRGATE(GGSH
HHHHHHH) (SEQ ID NO: 144)

>SARS-COV-2_RBD-noRpk_16GS_I53-50A*_E484K:
(MGILPSPGMPALLSLVSLLSVLLMGCVAETGT)RFPNITNLCPFGEVFNATRFASVYAWNRKRISNC
VADYSVLYNSASFSTFKCYGVSPTKLNDLCFTNVYADSFVIRGDEVRQIAPGQTGKIADYNYKLPDDF
TGCVIAWNSNNLDSKVGGNYNYLYRLFRKSNLKPFERDISTEIYQAGSTPCNGVKGFNCYFPLQSYGF
QPTNGVGYQPYRVVVLSFELLHAPATVCGPKKST(GGSGGSGSGGSGGSGSEKAAKAEEAAR)KMEEL
FKKHKIVAVLRANSVEEAIEKAVAVFAGGVHLIEITFTVPDADTVIKALSVLKEKGAIIGAGTVTSVE
QARKAVESGAEFIVSPHLDEEISQFAKEKGVFYMPGVMTPTELVKAMKLGHTILKLFPGEVVGPQFVK
AMKGPFPNVKFVPTGGVNLDNVAEWFKAGVLAVGVGSALVKGTPDEVREKAKAFVEKIRGATE(GGSH
HHHHHHH) (SEQ ID NO: 145)

>SARS-COV-2_RBD-noRpk_16GS_I53-50A*_L452R:
(MGILPSPGMPALLSLVSLLSVLLMGCVAETGT)RFPNITNLCPFGEVFNATRFASVYAWNRKRISNC
VADYSVLYNSASFSTFKCYGVSPTKLNDLCFTNVYADSFVIRGDEVRQIAPGQTGKIADYNYKLPDDF
TGCVIAWNSNNLDSKVGGNYNYRYRLFRKSNLKPFERDISTEIYQAGSTPCNGVEGFNCYFPLQSYGF
QPTNGVGYQPYRVVVLSFELLHAPATVCGPKKST(GGSGGSGSGGSGGSGSEKAAKAEEAAR)KMEEL
FKKHKIVAVLRANSVEEAIEKAVAVFAGGVHLIEITFTVPDADTVIKALSVLKEKGAIIGAGTVTSVE
QARKAVESGAEFIVSPHLDEEISQFAKEKGVFYMPGVMTPTELVKAMKLGHTILKLFPGEVVGPQFVK
AMKGPFPNVKFVPTGGVNLDNVAEWFKAGVLAVGVGSALVKGTPDEVREKAKAFVEKIRGATE(GGSH
HHHHHHH) (SEQ ID NO: 146)

>SARS-COV-2 RBD_N501Y_16GS-he-I53-50A*-His (UK):
(MGILPSPGMPALLSLVSLLSVLLMGCVA)RFPNITNLCPFGEVFNATRFASVYAWNRKRISNCVADY
SVLYNSASFSTFKCYGVSPTKLNDLCFTNVYADSFVIRGDEVRQIAPGQTGKIADYNYKLPDDFTGCV
IAWNSNNLDSKVGGNYNYLYRLFRKSNLKPFERDISTEIYQAGSTPCNGVEGFNCYFPLQSYGFQPTY
GVGYQPYRVVVLSFELLHAPATVCGPKKST(GGSGGSGSGGSGGSGSEKAAKAEEAAR)KMEELFKKH
KIVAVLRANSVEEAIEKAVAVFAGGVHLIEITFTVPDADTVIKALSVLKEKGAIIGAGTVTSVEQARK
AVESGAEFIVSPHLDEEISQFAKEKGVFYMPGVMTPTELVKAMKLGHTILKLFPGEVVGPQFVKAMKG
PFPNVKFVPTGGVNLDNVAEWFKAGVLAVGVGSALVKGTPDEVREKAKAFVEKIRGATE(GGSHHHHH
HHH) (SEQ ID NO: 147)

>SARS-COV-2 RBD_K417N_E484K_N501Y_16GS-he-I53-50A*-His (S.Africa)
(MGILPSPGMPALLSLVSLLSVLLMGCVA)RFPNITNLCPFGEVFNATRFASVYAWNRKRISNCVADY
SVLYNSASFSTFKCYGVSPTKLNDLCFTNVYADSFVIRGDEVRQIAPGQTGNIADYNYKLPDDFTGCV
IAWNSNNLDSKVGGNYNYLYRLFRKSNLKPFERDISTEIYQAGSTPCNGVKGFNCYFPLQSYGFQPTY
GVGYQPYRVVVLSFELLHAPATVCGPKKST(GGSGGSGSGGSGGSGSEKAAKAEEAAR)KMEELFKKH
KIVAVLRANSVEEAIEKAVAVFAGGVHLIEITFTVPDADTVIKALSVLKEKGAIIGAGTVTSVEQARK
AVESGAEFIVSPHLDEEISQFAKEKGVFYMPGVMTPTELVKAMKLGHTILKLFPGEVVGPQFVKAMKG
PFPNVKFVPTGGVNLDNVAEWFKAGVLAVGVGSALVKGTPDEVREKAKAFVEKIRGATE(GGSHHHHH
HHH) (SEQ ID NO: 148)

>SARS-COV-2_RBD-noRpk_16GS_I53-50A*_Brazil-ver_K417T_E484K_N501Y
(Brazil):
(MGILPSPGMPALLSLVSLLSVLLMGCVA)RFPNITNLCPFGEVFNATRFASVYAWNRKRISNCVADY
SVLYNSASFSTFKCYGVSPTKLNDLCFTNVYADSFVIRGDEVRQIAPGQTGTIADYNYKLPDDFTGCV
IAWNSNNLDSKVGGNYNYLYRLFRKSNLKPFERDISTEIYQAGSTPCNGVKGFNCYFPLQSYGFQPTY
GVGYQPYRVVVLSFELLHAPATVCGPKKST(GGSGGSGSGGSGGSGSEKAAKAEEAAR)KMEELFKKH
KIVAVLRANSVEEAIEKAVAVFAGGVHLIEITFTVPDADTVIKALSVLKEKGAIIGAGTVTSVEQARK
AVESGAEFIVSPHLDEEISQFAKEKGVFYMPGVMTPTELVKAMKLGHTILKLFPGEVVGPQFVKAMKG
PFPNVKFVPTGGVNLDNVAEWFKAGVLAVGVGSALVKGTPDEVREKAKAFVEKIRGATE(GGSHHHHH
HHH) (SEQ ID NO: 149)

>SARS-COV-2_RBD-noRpk_16GS_I53-50A*_E484K:
(MGILPSPGMPALLSLVSLLSVLLMGCVA)RFPNITNLCPFGEVFNATRFASVYAWNRKRISNCVADY
SVLYNSASFSTFKCYGVSPTKLNDLCFTNVYADSFVIRGDEVRQIAPGQTGKIADYNYKLPDDFTGCV
IAWNSNNLDSKVGGNYNYLYRLFRKSNLKPFERDISTEIYQAGSTPCNGVKGFNCYFPLQSYGFQPTN
GVGYQPYRVVVLSFELLHAPATVCGPKKST(GGSGGSGSGGSGGSGSEKAAKAEEAAR)KMEELFKKH
KIVAVLRANSVEEAIEKAVAVFAGGVHLIEITFTVPDADTVIKALSVLKEKGAIIGAGTVTSVEQARK
AVESGAEFIVSPHLDEEISQFAKEKGVFYMPGVMTPTELVKAMKLGHTILKLFPGEVVGPQFVKAMKG
PFPNVKFVPTGGVNLDNVAEWFKAGVLAVGVGSALVKGTPDEVREKAKAFVEKIRGATE(GGSHHHHH
HHH) (SEQ ID NO: 150)

>SARS-COV-2_RBD-noRpk_16GS_I53-50A*_L452R:
(MGILPSPGMPALLSLVSLLSVLLMGCVA)RFPNITNLCPFGEVFNATRFASVYAWNRKRISNCVADY
SVLYNSASFSTFKCYGVSPTKLNDLCFTNVYADSFVIRGDEVRQIAPGQTGKIADYNYKLPDDFTGCV
IAWNSNNLDSKVGGNYNYRYRLFRKSNLKPFERDISTEIYQAGSTPCNGVEGFNCYFPLQSYGFQPTN
GVGYQPYRVVVLSFELLHAPATVCGPKKST(GGSGGSGSGGSGGSGSEKAAKAEEAAR)KMEELFKKH
KIVAVLRANSVEEAIEKAVAVFAGGVHLIEITFTVPDADTVIKALSVLKEKGAIIGAGTVTSVEQARK
AVESGAEFIVSPHLDEEISQFAKEKGVFYMPGVMTPTELVKAMKLGHTILKLFPGEVVGPQFVKAMKG
PFPNVKFVPTGGVNLDNVAEWFKAGVLAVGVGSALVKGTPDEVREKAKAFVEKIRGATE(GGSHHHHH
HHH) (SEQ ID NO: 151)

In various embodiments, the polypeptide comprises the amino acid sequence selected from the group consisting of SEQ ID NOS: 1-12 and 142-151. In various other embodiments, the polypeptides comprises an amino acid sequence at least 95%, at least 96%, at least 97%, at least 98%, at least 99%, or at least 100% identical to the amino acid sequence selected from the group consisting of SEQ ID NOS: 1-8, or the group consisting of SEQ ID NOS: 1-4, SEQ ID NOS: 5-8, or the group consisting of SEQ ID NOS: 1 and 5, provided as exemplary embodiments in the examples that follow.

As used throughout the present application, the term "polypeptide" is used in its broadest sense to refer to a sequence of subunit D- or L-amino acids, including canonical and non-canonical amino acids. The polypeptides described herein may be chemically synthesized or recombinantly expressed. The polypeptides may be linked to other compounds to promote an increased half-life in vivo, such as by PEGylation, HESylation, PASylation, glycosylation, or may be produced as an Fc-fusion or in deimmunized variants. Such linkage can be covalent or non-covalent as is understood by those of skill in the art.

In a second aspect, the disclosure provides nanoparticles comprising a plurality of polypeptides according to any embodiment or combination of embodiments of the first aspect of the disclosure. In this aspect, a plurality (2, 3, 4, 5, 10. 20, 25, 50, 60, 100, or more) polypeptides of the first aspect of the disclosure are present in any suitable nanoparticle.

Nanoparticles of any embodiment or aspect of this disclosure can be of any suitable size for an intended use, including but not limited to about 10 nm to about 100 nm in diameter.

In a third aspect, the disclosure provides nanoparticles, comprising:

(a) a plurality of first assemblies, each first assembly comprising a plurality of identical first proteins; and, (b) a plurality of second assemblies, each second assembly comprising a plurality of second proteins;

wherein the amino acid sequence of the first protein differs from the sequence of the second protein;

wherein the plurality of first assemblies non-covalently interact with the plurality of second assemblies to form the nanoparticle; and, wherein the nanoparticle displays on its surface an immunogenic portion of a SARS-CoV-2 antigen or a variant or homolog thereof, present in the at least one second protein.

In this aspect, the nanoparticle forms a three-dimensional structure formed by the non-covalent interaction of the first and second assemblies. A plurality (2, 3, 4, 5, 6, or more) of first polypeptides self-assemble to form a first assembly, and a plurality (2, 3, 4, 5, 6, or more) of second polypeptides self-assemble to form a second assembly. Non-covalent interaction of the individual self-assembling proteins results in self-assembly of the first protein into first assemblies, and self-assembly of the second proteins into second assemblies. A plurality of these first and second assemblies then self-assemble non-covalently via interfaces to produce the nanoparticles. The number of first polypeptides in the first assemblies may be the same or different than the number of second polypeptides in the second assemblies. Nanoparticles of this disclosure can have any shape and/or symmetry suitable for an intended use, including, but not limited to, tetrahedral, octahedral, icosahedral, dodecahedral, and truncated forms thereof. In one exemplary embodiment, each first assembly is pentameric and each second assembly is trimeric.

Assembly of the first and second assemblies into nanoparticles is not random, but is dictated by non-covalent interactions (e.g., hydrogen bonds, electrostatic, Van der Waals, hydrophobic, etc.) between the various assemblies (i.e., the cumulative effect of interactions between first assemblies, interactions between second assemblies, and interactions between first and second assemblies). Consequently, nanoparticles of this disclosure comprise symmetrically repeated, non-natural, non-covalent, protein-protein interfaces that orient the first and second assemblies into a nanoparticle having a highly ordered structure. While the formation of nanoparticles is due to non-covalent interactions of the first and second assemblies, in some embodiments, once formed, nanoparticles may be stabilized by covalent linking between proteins in the first assemblies and the second assemblies. Any suitable covalent linkage may be used, including but not limited to disulfide bonds and isopeptide linkages.

First proteins and second proteins suitable for producing assemblies of this disclosure may be of any suitable length for a given nanoparticle. First proteins and second proteins may be between 30 and 250 amino acids in length.

In one embodiment, the second proteins comprise an amino acid sequence at least 95%, at least 96%, at least 97%, at least 98%, at least 99%, or at least 100% identical to the amino acid sequence selected from the group consisting of SEQ ID NOS: 85-124 or 185-193 (Table 2), wherein X1 for at least one second protein comprises an immunogenic portion of a SARS-COV-2 antigen or a variant or homolog thereof, X2 is absent or an amino acid linker, and residues in parentheses are optional. The optional residues may be present, or some (i.e.: 1, 2, 3, 4, 5, 6, or more) or all of the optional residues may be absent.

TABLE 2

| Protein name | Protein type | Expressed sequence (optional residues in parentheses) |
| --- | --- | --- |
| SARS-CoV-2 RBD-I53-50A*-16GS-he-His | SARS-CoV-2-I53-50A fusion protein | X1-GGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 85)<br>X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 86) |

TABLE 2-continued

| Protein name | Protein type | Expressed sequence (optional residues in parentheses) |
|---|---|---|
| | | X1-GGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 87) |
| | | X1-(X2)KMEELFKKHKIVAVLRANSVEEAIEKAVAVFAGGVHLIEITFTVPDADTVIKALSVLKEKGAIIGAGTVTSVEQARKAVESGAFFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 88) |
| SARS-CoV-2 RBD-I53-50A*-8GS-he-His | SARS-CoV-2-I53-50A fusion protein | X1-GGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 89) |
| | | X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 90) |
| | | X1-GGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 91) |
| | | X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 92) |
| SARS-CoV-2 RBD-I53-50A*-12GS-he-His | SARS-CoV-2-I53-50A fusion protein | X1-GSGSGGSGGSGSEKAAKAEEAARKMEELFKKHKIVAVLRANSVEEAIEKAVAVEAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 93) |
| | | X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 94) |
| | | X1-GSGSGGSGGSGSEKAAKAEEAARKMEELFKKHKIVAVLRANSVEEAIEKAVAVEAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 95) |
| | | X1-(X2)KMEELFKKHKIVAVLRANSVEEAIEKAVAVGAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 96) |
| SARS-CoV-2 PSGAG-S-TEV-FO-I53-50A*-12GS-he-His (+ foldon) | SARS-CoV-2-I53-50A fusion protein | X1-gsgrenlyfqggggsgyipeaprdgqayvrkdgewvllstflgGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPEPNVKFVPTGGVNLDNVAEWFKAGVLAVGVGSALVKGTPDEVREKAKAFVEKIRGATE (SEQ ID NO: 97) |
| | | X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 98) |

TABLE 2-continued

| Protein name | Protein type | Expressed sequence (optional residues in parentheses) |
|---|---|---|
| | | X1-gsgrenlyfqgggggsgyipeaprdgqayvrkdgewvllstflgGSGSGGSGGSGSEKAAKAEEAARKMEELFKKHKIVAVLRANSVEEAIEKAVAVFAGGVHLIEITETVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 99)<br>X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 100) |
| SARS-<br>CoV-2<br>2 PSGAG-<br>S-I53-<br>50A*-<br>12GS-he-<br>His<br>(-<br>foldon) | SARS-CoV-<br>2-I53-50A<br>fusion<br>protein | X1-GSGSGGSGGSGSEKAAKAEEAARKMEELFKKHKIVAVLRANSVEEAIEKAVAVEAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 101)<br>X1-(X2)KMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE (SEQ ID NO: 102)<br>X1-GSGSGGSGGSGSEKAAKAEEAARKMEELFKKHKIVAVLRANSVEEAIEKAVAVEAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWEKAGVLAVGVGSALVKGTPDEVREKAKAFVEKIRGATE(GGSHHHHHHHH) (SEQ ID NO: 103)<br>X1-(X2)RKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE(GGSHHHHHHHH) (SEQ ID NO: 104) |
| SARS-<br>CoV-2<br>RB<br>D-I3-<br>01*-<br>secOpt-<br>8GS-he-<br>His | SARS-CoV-<br>2-I3-01<br>fusion<br>protein | X1-GGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 105)<br>X1-(X2)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 106)<br>X1-GGSGGSGSEKAAKAEEAARMEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 107)<br>X1-(X2)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVEYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 108) |
| SARS-<br>CoV-2<br>RB<br>D-I3-<br>01* -<br>secOpt-<br>12GS-he-<br>His | SARS-CoV-<br>2-13-01<br>fusion<br>protein | X1-GSGSGGSGGSGSEKAAKAEEAARMEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 109)<br>X1-(X2)MEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVEYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE (SEQ ID NO: 110) |

TABLE 2-continued

| Protein name | Protein type | Expressed sequence (optional residues in parentheses) |
|---|---|---|
| | | X1-<br>GSGSGGSGGSGSEKAAKAEEAARMEELFKEHKIVAVLRANSVEEAKKKALAVEL<br>GGVDLIEITFTVPDADTVIKELSFLKEMGAIIGAGTVTSVEQAREAVESGAEFI<br>VSPHLDEEISQFAKEEGVFYMPGVMTPTELVKAMKLGHTILKLFPGEVVGPQFV<br>EAMKGPFPNVKFVPTGGVNLDNVAEWFEAGVQAVGVGEALNEGTPVEVAEKAKA<br>FVEKIEGATE(GGSHHHHHHHH) (SEQ ID NO: 111)<br>X1-<br>(X2)MEELFKEHKIVAVLRANSVEEAKKKALAVELGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE(GGSHHHHH<br>HHH) (SEQ ID NO: 112) |
| SARS-CoV-2 RBD-I3-01*-secOpt-16GS-he-His | SARS-CoV-2-I3-01 fusion protein | X1-<br>GGSGGSGSGGSGGSGSEKAAKAEEAARMEELFKEHKIVAVLRANSVEEAKKKAL<br>AVFLGGVDLIEITFTVPDADTVIKELSFLKEMGAIIGAGTVTSVEQAREAVESG<br>AEFIVSPHLDEEISQFAKEEGVFYMPGVMTPTELVKAMKLGHTILKLFPGEVVG<br>PQFVEAMKGPFPNVKFVPTGGVNLDNVAEWFEAGVQAVGVGEALNEGTPVEVAE<br>KAKAFVEKIEGATE (SEQ ID NO: 113)<br>X1-<br>(X2)MEELFKEHKIVAVLRANSVEEAKKKALAVFLGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE (SEQ ID<br>NO: 114)<br>X1-<br>GGSGGSGSGGSGGSGSEKAAKAEEAARMEELFKEHKIVAVLRANSVEEAKKKAL<br>AVFLGGVDLIEITFTVPDADTVIKELSFLKEMGAIIGAGTVTSVEQAREAVESG<br>AEFIVSPHLDEEISQFAKEEGVFYMPGVMTPTELVKAMKLGHTILKLFPGEVVG<br>PQFVEAMKGPFPNVKFVPTGGVNLDNVAEWFEAGVQAVGVGEALNEGTPVEVAE<br>KAKAFVEKIEGATE(GGSHHHHHHHH) (SEQ ID NO: 115)<br>X1-<br>(X2)MEELFKEHKIVAVLRANSVEEAKKKALAVFLGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE(GGSHHHHH<br>HHH) (SEQ ID NO: 116) |
| SARS-CoV-2 2P SGAG-S-TEV-FO-I3-01*-secOpt-12GS-he-His (+ foldon) | SARS-CoV-2-I3-01 fusion protein | X1-<br>gsgrenlyfqgggggsgyipeaprdgqayvrkdgewvllstflgGSGSGGSGGSG<br>SEKAAKAEEAARMEELFKEHKIVAVLRANSVEEAKKKALAVELGGVDLIEITFT<br>VPDADTVIKELSFLKEMGAIIGAGTVTSVEQAREAVESGAEFIVSPHLDEEISQ<br>FAKEEGVFYMPGVMTPTELVKAMKLGHTILKLFPGEVVGPQFVEAMKGPEPNVK<br>FVPTGGVNLDNVAEWFEAGVQAVGVGEALNEGTPVEVAEKAKAFVEKIEGATE<br>(SEQ ID NO: 117)<br>X1-<br>(X2)MEELFKEHKIVAVLRANSVEEAKKKALAVFLGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE (SEQ ID<br>NO: 118)<br>X1-<br>gsgrenlyfqgggggsgyipeaprdgqayvrkdgewvllstflgGSGSGGSGGSG<br>SEKAAKAEEAARMEELFKEHKIVAVLRANSVEEAKKKALAVELGGVDLIEITFT<br>VPDADTVIKELSFLKEMGAIIGAGTVTSVEQAREAVESGAEFIVSPHLDEEISQ<br>FAKEEGVFYMPGVMTPTELVKAMKLGHTILKLFPGEVVGPQFVEAMKGPFPNVK<br>FVPTGGVNLDNVAEWFEAGVQAVGVGEALNEGTPVEVAEKAKAFVEKIEGATE<br>(GGSHHHHHHHH) (SEQ ID NO: 119)<br>X1-<br>(X2)MEELFKEHKIVAVLRANSVEEAKKKALAVFLGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE(GGSHHHHH<br>HHH) (SEQ ID NO: 120) |
| SARS-CoV-2 2 PSGAG-S-I3-01*-secOpt-12GS-he-His (- foldon) | SARS-CoV-2-I3-01 fusion protein | X1-<br>GSGSGGSGGSGSEKAAKAEEAARMEELFKEHKIVAVLRANSVEEAKKKALAVEL<br>GGVDLIEITFTVPDADTVIKELSFLKEMGAIIGAGTVTSVEQAREAVESGAEFI<br>VSPHLDEEISQFAKEEGVFYMPGVMTPTELVKAMKLGHTILKLFPGEVVGPQFV<br>EAMKGPFPNVKFVPTGGVNLDNVAEWFEAGVQAVGVGEALNEGTPVEVAEKAKA<br>FVEKIEGATE (SEQ ID NO: 121)<br>X1-<br>(X2)MEELFKEHKIVAVLRANSVEEAKKKALAVELGGVDLIEITFTVPDADTVI<br>KELSFLKEMGAIIGAGTVTSVEQAREAVESGAEFIVSPHLDEEISQFAKEEGVF<br>YMPGVMTPTELVKAMKLGHTILKLFPGEVVGPQFVEAMKGPFPNVKFVPTGGVN<br>LDNVAEWFEAGVQAVGVGEALNEGTPVEVAEKAKAFVEKIEGATE (SEQ ID<br>NO: 122) |

TABLE 2-continued

| Protein name | Protein type | Expressed sequence (optional residues in parentheses) |
|---|---|---|
| | | X1-GSGSGGSGGSGSEKAAKAEEAARMEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 123) |
| | | X1-(X2)MEELFKEHKIVAVLRANSVEEAKKKALAVELGGVDLIEITFTVPDADTVIKELSFLKEMGAIIGAGTVTSVEQAREAVESGAEFIVSPHLDEEISQFAKEEGVEYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE(GGSHHHHHHHH) (SEQ ID NO: 124) |
| I53_dn5A W16E | Degreased nanoparticle protein | (METDTLLLWVLLLWVPGSTGDYKDE)KKYDGSKLRIGILHARENAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKEN(LEGSEQKLISEEDLHHHHHH) (SEQ ID NO: 185) |
| I53_dn5A L29N | Degreased nanoparticle protein | (METDTLLLWVLLLWVPGSTGDYKDE)KKYDGSKLRIGILHARWNAEIILALVLGANKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKEN(LEGSEQKLISEEDLHHHHHH) (SEQ ID NO: 186) |
| I53_dn5A 'mut101' [T116N/ L118D 1 T119K | Degreased nanoparticle protein | (METDTLLLWVLLLWVPGSTGDYKDE)KKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLNCDKDEQAEARAGLIEGKMHNHGEDWGAAAVEMATKEN(LEGSEQKLISEEDLHHHHHH) (SEQ ID NO: 187) |
| I53_dn5A T116N | Degreased nanoparticle protein | (METDTLLLWVLLLWVPGSTGDYKDE)KKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLNCLTDEQAEARAGLIEGKMHNHGEDWGAAAVEMATKEN(LEGSEQKLISEEDLHHHHHH) (SEQ ID NO: 188) |
| I53_dn5A L118D | Degreased nanoparticle protein | (METDTLLLWVLLLWVPGSTGDYKDE)KKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCDTDEQAEARAGLIEGKMHNHGEDWGAAAVEMATKEN(LEGSEQKLISEEDLHHHHHH) (SEQ ID NO: 189) |
| I53_dn5A T119K | Degreased nanoparticle protein | (METDTLLLWVLLLWVPGSTGDYKDE)KKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLKDEQAEARAGLIEGKMHNHGEDWGAAAVEMATKEN(LEGSEQKLISEEDLHHHHHH) (SEQ ID NO: 190) |
| I53_ dn5A.1 | Degreased nanoparticle protein | (METDTLLLWVLLLWVPGSTGDYKDEMG)KYDGSKLRIGILHARGNAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKEN(LEGSEQKLISEEDLHHHHHH) (SEQ ID NO: 191) |
| I53_ dn5A.1 W16E | Degreased nanoparticle protein | (METDTLLLWVLLLWVPGSTGDYKDEMG)KYDGSKLRIGILHARENAEIILALVLGALKRLQEFGVKRENIIIETVPGSFELPYGSKLFVEKQKRLGKPLDAIIPIGVLIRGSTPHEDYIADSTTHQLMKLNFELGIPVIFGVITADTDEQAEARAGLIEGKMHNHGEDWGAAAVEMATKEN(LEGSEQKLISEEDLHHHHHH) (SEQ ID NO: 192) |
| I53_ dn5A.2 | Degreased nanoparticle protein | (METDTLLLWVLLLWVPGSTGDYKDEMG)KYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKEN(LEGSEQKLISEEDLHHHHHH) (SEQ ID NO: 193) |

In various embodiments of this third aspect, the second proteins comprise an amino acid sequence at least 95%, at least 96%, at least 97%, at least 98%, at least 99%, or at least 100% identical to the amino acid sequence selected from the group consisting of SEQ ID NOS: 85-88. In various other embodiments, the polypeptides comprise the amino acid sequence selected from the group consisting of SEQ ID NOS: 85-88, or the group consisting of SEQ ID NOS: 85-86, or SEQ ID NOS: 85, provided as exemplary embodiments in the examples that follow.

The nanoparticles of this third aspect display on their surface an immunogenic portion of a SARS-COV-2 antigen or a variant or homolog thereof, present in the at least one second protein. In one embodiment, the immunogenic portion of a SARS-COV-2 antigen or a variant or homolog thereof is present as fusion protein with at least one second protein; it can be present on a single second protein in the nanoparticle (present in a single copy on the nanoparticle), or present in a plurality of second proteins present in the nanoparticle. In various embodiments, the SARS-COV-2 antigen or a variant or homolog thereof is present in at least 20%, 30%, 40%, 50%, 60%, 70%, 80%, 90%, or 100% of the second proteins in the nanoparticle.

In these fusion proteins, the second protein may be joined directly to the SARS-COV-2 antigen or a variant or homolog thereof, or the second protein and the SARS-COV-2 antigen or a variant or homolog thereof may be joined using a linker. As used throughout this disclosure, a linker is a short (e.g., 2-30) amino acid sequence used to covalently join two polypeptides. Any suitable linker sequence may be used, including but not limited to those disclosed herein.

Any suitable SARS-COV-2 antigen or a variant or homolog thereof may be used. In one embodiment of this third aspect, X1 in at least 20%, 30%, 40%, 50%, 60%, 70%, 80%, 90%, or 100% of the second proteins comprises an amino acid sequence having at least 75%, 80%, 85%, 90%, 91%, 92%, 93%, 94%, 95%, 96%, 97%, 98%, 99%, or 100% amino acid sequence identity to a Spike(S) protein extracellular domain (ECD) amino acid sequence, an S1 subunit amino acid sequence, an S2 subunit amino acid sequence, an S1 receptor binding domain (RBD) amino acid sequence, and/or an N-terminal domain (NTD) amino acid sequence, from SARS-COV-2, or a variant or homolog thereof.

In various further embodiments, X1 in at least 20%, 30%, 40%, 50%, 60%, 70%, 80%, 90%, or 100% of the second proteins comprises an amino acid sequence having at least 75%, 80%, 85%, 90%, 91%, 92%, 93%, 94%, 95%, 96%, 97%, 98%, 99%, or 100% amino acid sequence identity to the amino acid sequence selected from the group consisting of SEQ ID NO: 125-137.

SEQ ID NO: 125

```
RFPNITNLCPFGEVENATRFASVYAWNRKRISNCVADYSVLYNSASFSTFKCYGVSPTKLNDLCFTNV

YADSFVIRGDEVRQIAPGQTGKIADYNYKLPDDFTGCVIAWNSNNLDSKVGGNYNYLYRLERKSNLKP

FERDISTEIYQAGSTPCNGVEGENCYFPLQSYGFQPTNGVGYQPYRVVVLSFELLHAPATVCGPKKST

(RBD)
```

SEQ ID NO: 126

```
ETGTRFPNITNLCPFGEVENATRFASVYAWNRKRISNCVADYSVLYNSASFSTFKCYGVSPTKLNDLC

FTNVYADSFVIRGDEVRQIAPGQTGKIADYNYKLPDDFTGCVIAWNSNNLDSKVGGNYNYLYRLFRKS

NLKPFERDISTEIYQAGSTPCNGVEGENCYFPLQSYGFQPTNGVGYQPYRVVVLSFELLHAPATVCGP

KKST(RBD)
```

SEQ ID NO: 127

```
QCVNLTTRTQLPPAYTNSFTRGVYYPDKVFRSSVLHSTQDLFLPFFSNVTWFHAIHVSGTNGTKREDN

PVLPFNDGVYFASTEKSNIIRGWIFGTTLDSKTQSLLIVNNATNVVIKVCEFQFCNDPFLGVYYHKNN

KSWMESEFRVYSSANNCTFEYVSQPFLMDLEGKQGNFKNLREFVFKNIDGYFKIYSKHTPINLVRDLP

QGFSALEPLVDLPIGINITRFQTLLALHRSYLTPGDSSSGWTAGAAAYYVGYLQPRTELLKYNENGTI

TDAVDCALDPLSETKCTLKSFTVEKGIYQTSNERVQPTESIVRFPNITNLCPFGEVENATRFASVYAW

NRKRISNCVADYSVLYNSASFSTFKCYGVSPTKLNDLCFTNVYADSFVIRGDEVRQIAPGQTGKIADY

NYKLPDDFTGCVIAWNSNNLDSKVGGNYNYLYRLERKSNLKPFERDISTEIYQAGSTPCNGVEGENCY

FPLQSYGFQPTNGVGYQPYRVVVLSFELLHAPATVCGPKKSTNLVKNKCVNFNFNGLTGTGVLTESNK

KFLPFQQFGRDIADTTDAVRDPQTLEILDITPCSFGGVSVITPGTNTSNQVAVLYQDVNCTEVPVAIH

ADQLTPTWRVYSTGSNVFQTRAGCLIGAEHVNNSYECDIPIGAGICASYQTQTNSPSGAGSVASQSII

AYTMSLGAENSVAYSNNSIAIPTNFTISVTTEILPVSMTKTSVDCTMYICGDSTECSNLLLQYGSFCT

QLNRALTGIAVEQDKNTQEVFAQVKQIYKTPPIKDFGGFNFSQILPDPSKPSKRSFIEDLLENKVTLA

DAGFIKQYGDCLGDIAARDLICAQKFNGLTVLPPLLTDEMIAQYTSALLAGTITSGWTFGAGAALQIP

FAMQMAYRFNGIGVTQNVLYENQKLIANQFNSAIGKIQDSLSSTASALGKLQDVVNQNAQALNTLVKQ

LSSNFGAISSVLNDILSRLDPPEAEVQIDRLITGRLQSLQTYVVTQQLIRAAEIRASANLAATKMSECV
```

-continued

LGQSKRVDFCGKGYHLMSFPQSAPHGVVFLHVTYVPAQEKNFTTAPAICHDGKAHFPREGVFVSNGTH

WFVTQRNFYEPQIITTDNTFVSGNCDVVIGIVNNTVYDPLQPELDSFKEELDKYFKNHTSPDVDLGDI

SGINASVVNIQKEIDRLNEVAKNLNESLIDLQELGKYEQYIK (Spike (S) protein extracellular domain (ECD))

SEQ ID NO: 128

(ETGT) QCVNLTTRTQLPPAYTNSFTRGVYYPDKVFRSSVLHSTQDLFLPFFSNVTWFHAIHVSGTNG

TKRFDNPVLPFNDGVYFASTEKSNIIRGWIFGTTLDSKTQSLLIVNNATNVVIKVCEFQFCNDPFLGV

YYHKNNKSWMESEFRVYSSANNCTFEYVSQPFLMDLEGKQGNFKNLREFVFKNIDGYFKIYSKHTPIN

LVRDLPQGFSALEPLVDLPIGINITRFQTLLALHRSYLTPGDSSSGWTAGAAAYYVGYLQPRTELLKY

NENGTITDAVDCALDPLSETKCTLKSFTVEKGIYQTSNERVQPTESIVRFPNITNLCPFGEVENATRE

ASVYAWNRKRISNCVADYSVLYNSASFSTFKCYGVSPTKLNDLCFTNVYADSFVIRGDEVRQIAPGQT

GKIADYNYKLPDDFTGCVIAWNSNNLDSKVGGNYNYLYRLFRKSNLKPFERDISTEIYQAGSTPCNGV

EGFNCYFPLQSYGFQPTNGVGYQPYRVVVLSFELLHAPATVCGPKKSTNLVKNKCVNFNENGLTGTGV

LTESNKKFLPFQQFGRDIADTTDAVRDPQTLEILDITPCSFGGVSVITPGTNTSNQVAVLYQDVNCTE

VPVAIHADQLTPTWRVYSTGSNVFQTRAGCLIGAEHVNNSYECDIPIGAGICASYQTQTNSPSGAGSV

ASQSIIAYTMSLGAENSVAYSNNSIAIPTNFTISVTTEILPVSMTKTSVDCTMYICGDSTECSNLLLQ

YGSFCTQLNRALTGIAVEQDKNTQEVFAQVKQIYKTPPIKDFGGFNFSQILPDPSKPSKRSFIEDLLF

NKVTLADAGFIKQYGDCLGDIAARDLICAQKENGLTVLPPLLTDEMIAQYTSALLAGTITSGWTFGAG

AALQIPFAMQMAYRENGIGVTQNVLYENQKLIANQFNSAIGKIQDSLSSTASALGKLQDVVNQNAQAL

NTLVKQLSSNFGAISSVLNDILSRLDPPEAEVQIDRLITGRLQSLQTYVTQQLIRAAEIRASANLAAT

KMSECVLGQSKRVDFCGKGYHLMSFPQSAPHGVVFLHVTYVPAQEKNFTTAPAICHDGKAHFPREGVE

VSNGTHWFVTQRNFYEPQIITTDNTFVSGNCDVVIGIVNNTVYDPLQPELDSFKEELDKYFKNHTSPD

VDLGDISGINASVVNIQKEIDRLNEVAKNLNESLIDLQELGKYEQYIK (Spike (S) protein extracellular domain (ECD), including N-terminal linker related to signal peptide in parentheses, which may be present or absent)

(SEQ ID NO: 129)

MGILPSPGMPALLSLVSLLSVLLMGCVAETGTQCVNLTTRTQLPPAYTNSFTRGVYYPDKVFRSSVLH

STQDLFLPFFSNVTWFHAIHVSGTNGTKRFDNPVLPENDGVYFASTEKSNIIRGWIFGTTLDSKTQSL

LIVNNATNVVIKVCEFQFCNDPFLGVYYHKNNKSWMESEFRVYSSANNCTFEYVSQPFLMDLEGKQGN

FKNLREFVFKNIDGYFKIYSKHTPINLVRDLPQGFSALEPLVDLPIGINITRFQTLLALHRSYLTPGD

SSSGWTAGAAAYYVGYLQPRTELLKYNENGTITDAVDCALDPLSETKCTLKSFTVEKGIYQTSNERVQ

PTESIVRFPNITNLCPFGEVENATRFASVYAWNRKRISNCVADYSVLYNSASFSTFKCYGVSPTKLND

LCFTNVYADSFVIRGDEVRQIAPGQTGKIADYNYKLPDDFTGCVIAWNSNNLDSKVGGNYNYLYRLER

KSNLKPFERDISTEIYQAGSTPCNGVEGENCYFPLQSYGFQPTNGVGYQPYRVVVLSFELLHAPATVC

GPKKSTNLVKNKCVNFNFNGLTGTGVLTESNKKFLPFQQFGRDIADTTDAVRDPQTLEILDITPCSFG

GVSVITPGTNTSNQVAVLYQDVNCTEVPVAIHADQLTPTWRVYSTGSNVFQTRAGCLIGAEHVNNSYE

CDIPIGAGICASYQTQTNSPSGAGSVASQSIIAYTMSLGAENSVAYSNNSIAIPTNFTISVTTEILPV

SMTKTSVDCTMYICGDSTECSNLLLQYGSFCTQLNRALTGIAVEQDKNTQEVFAQVKQIYKTPPIKDF

GGFNFSQILPDPSKPSKRSFIEDLLENKVTLADAGFIKQYGDCLGDIAARDLICAQKFNGLTVLPPLL

TDEMIAQYTSALLAGTITSGWTFGAGAALQIPFAMQMAYRENGIGVTQNVLYENQKLIANQFNSAIGK

IQDSLSSTASALGKLQDVVNQNAQALNTLVKQLSSNFGAISSVLNDILSRLDPPEAEVQIDRLITGRL

-continued

QSLQTYVTQQLIRAAEIRASANLAATKMSECVLGQSKRVDFCGKGYHLMSFPQSAPHGVVFLHVTYVP

AQEKNFTTAPAICHDGKAHFPREGVFVSNGTHWFVTQRNFYEPQIITTDNTFVSGNCDVVIGIVNNTV

YDPLQPELDSFKEELDKYFKNHTSPDVDLGDISGINASVVNIQKEIDRLNEVAKNLNESLIDLQELGK

YEQYIK mu phosphatase signal peptide, and the ETGT is left over as a remnant after signal peptide cleavage (SEQ ID NO: 130)

(MFVFLVLLPLVSSQC)VNLTTRTQLPPAYTNSFTRGVYYPDKVERSSVLHSTQDLFLPFFSNVTWFHAIHVSGT

NGTKRFDNPVLPENDGVYFASTEKSNIIRGWIFGTTLDSKTQSLLIVNNATNVVIKVCEFQFCNDPFLGVYYHKN

NKSWMESEFRVYSSANNCTFEYVSQPFLMDLEGKQGNFKNLREFVFKNIDGYFKIYSKHTPINLVRDLPQGESAL

EPLVDLPIGINITRFQTLLALHRSYLTPGDSSSGWTAGAAAYYVGYLQPRTELLKYNENGTITDAVDCALDPLSE

TKCTLKSFTVEKGIYQTSNERVQPTESIVREPNITNLCPFGEVENATRFASVYAWNRKRISNCVADYSVLYNSAS

FSTFKCYGVSPTKLNDLCFTNVYADSFVIRGDEVRQIAPGQTGKIADYNYKLPDDETGCVIAWNSNNLDSKVGGN

YNYLYRLERKSNLKPFERDISTEIYQAGSTPCNGVEGENCYFPLQSYGFQPTNGVGYQPYRVVVLSFELLHAPAT

VCGPKKSTNLVKNKCVNENENGLTGTGVLTESNKKELPFQQFGRDIADTTDAVRDPQTLEILDITPCSFGGVSVI

TPGTNTSNQVAVLYQDVNCTEVPVAIHADQLTPTWRVYSTGSNVFQTRAGCLIGAEHVNNSYECDIPIGAGICAS

YQTQTNSPGSASSVASQSIIAYTMSLGAENSVAYSNNSIAIPTNFTISVTTEILPVSMTKTSVDCTMYICGDSTE

CSNLLLQYGSFCTQLNRALTGIAVEQDKNTQEVFAQVKQIYKTPPIKDFGGENFSQILPDPSKPSKRSPIEDLLE

NKVTLADAGFIKQYGDCLGDIAARDLICAQKENGLTVLPPLLTDEMIAQYTSALLAGTITSGWTFGAGPALQIPF

PMQMAYRENGIGVTQNVLYENQKLIANQFNSAIGKIQDSLSSTPSALGKLQDVVNQNAQALNTLVKQLSSNFGAI

SSVLNDILSRLDPPEAEVQIDRLITGRLQSLQTYVTQQLIRAAEIRASANLAATKMSECVLGQSKRVDFCGKGYH

LMSFPQSAPHGVVFLHVTYVPAQEKNFTTAPAICHDGKAHFPREGVFVSNGTHWFVTQRNFYEPQIITTDNTFVS

GNCDVVIGIVNNTVYDPLQPELDSFKEELDKYFKNHTSPDVDLGDISGINASVVNIQKEIDRLNEVAKNLNESLI

DLQELGKYEQ (SEQ ID NO: 131)

(MFVFLVLLPLVSSQC)VNLTTRTQLPPAYTNSFTRGVYYPDKVFRSSVLHSTQDLFLPFFSNVTWFHAIHVSGT

NGTKRFDNPVLPENDGVYFASTEKSNIIRGWIFGTTLDSKTQSLLIVNNATNVVIKVCEFQFCNDPFLGVYYHKN

NKSWMESEFRVYSSANNCTFEYVSQPFLMDLEGKQGNFKNLREFVFKNIDGYFKIYSKHTPINLVRDLPQGESAL

EPLVDLPIGINITRFQTLLALHRSYLTPGDSSSGWTAGAAAYYVGYLQPRTELLKYNENGTITDAVDCALDPLSE

TKCTLKSFTVEKGIYQTSNERVQPTESIVRFPNITNLCPFGEVENATRFASVYAWNRKRISNCVADYSVLYNSAS

FSTFKCYGVSPTKLNDLCFTNVYADSFVIRGDEVRQIAPGQTGKIADYNYKLPDDETGCVIAWNSNNLDSKVGGN

YNYLYRLFRKSNLKPFERDISTEIYQAGSTPCNGVEGENCYFPLQSYGFQPTNGVGYQPYRVVVLSFELLHAPAT

VCGPKKSTNLVKNKCVNFNFNGLTGTGVLTESNKKELPFQQFGRDIADTTDAVRDPQTLEILDITPCSFGGVSVI

TPGTNTSNQVAVLYQDVNCTEVPVAIHADQLTPTWRVYSTGSNVFQTRAGCLIGAEHVNNSYECDIPIGAGICAS

YQTQTNSPGSASSVASQSIIAYTMSLGAENSVAYSNNSIAIPTNFTISVTTEILPVSMTKTSVDCTMYICGDSTE

CSNLLLQYGSFCTQLNRALTGIAVEQDKNTQEVFAQVKQIYKTPPIKDFGGFNFSQILPDPSKPSKRSPIEDLLE

NKVTLADAGFIKQYGDCLGDIAARDLICAQKENGLTVLPPLLTDEMIAQYTSALLAGTITSGWTFGAGPALQIPF

PMQMAYRENGIGVTQNVLYENQKLIANQFNSAIGKIQDSLSSTPSALGKLQDVVNQNAQALNTLVKQLSSNFGAI

SSVLNDILSRLDPPEAEVQIDRLITGRLQSLQTYVTQQLIRAAEIRASANLAATKMSECVLGQSKRVDFCGKGYH

LMSFPQSAPHGVVFLHVTYVPAQEKNFTTAPAICHDGKAHFPREGVFVSNGTHWFVTQRNFYEPQIITTDNTFVS

GNCDVVIGIVNNTVYDPLQPELDSFKEELDKYFKNHT

-continued (SEQ ID NO: 132)
(QC)VNLTTRTQLPPAYTNSFTRGVYYPDKVFRSSVLHSTQDLFLPFFSNVTWFHAIHVSGTNGTKREDNPVLPF
NDGVYFASTEKSNIIRGWIFGTTLDSKTQSLLIVNNATNVVIKVCEFQFCNDPFLGVYYHKNNKSWMESEFRVYS
SANNCTFEYVSQPFLMDLEGKQGNEKNLREFVEKNIDGYFKIYSKHTPINLVRDLPQGFSALEPLVDLPIGINIT
RFQTLLALHRSYLTPGDSSSGWTAGAAAYYVGYLQPRTELLKYNENGTITDAVDCALDPLSETKCTLKSETVEKG
IYQTSNFRVQPTESIVRFPNITNLCPFGEVENATRFASVYAWNRKRISNCVADYSVLYNSASFSTFKCYGVSPTK
LNDLCFTNVYADSFVIRGDEVRQIAPGQTGKIADYNYKLPDDFTGCVIAWNSNNLDSKVGGNYNYLYRLERKSNL
KPFERDISTEIYQAGSTPCNGVEGENCYFPLQSYGFQPTNGVGYQPYRVVVLSFELLHAPATVCGPKKSTNLVKN
KCVNFNFNGLTGTGVLTESNKKELPFQQFGRDIADTTDAVRDPQTLEILDITPCSFGGVSVITPGTNTSNQVAVL
YQDVNCTEVPVAIHADQLTPTWRVYSTGSNVFQTRAGCLIGAEHVNNSYECDIPIGAGICASYQTQTNSPGSASS
VASQSIIAYTMSLGAENSVAYSNNSIAIPTNFTISVTTEILPVSMTKTSVDCTMYICGDSTECSNLLLQYGSFCT
QLNRALTGIAVEQDKNTQEVFAQVKQIYKTPPIKDFGGENFSQILPDPSKPSKRSPIEDLLENKVTLADAGFIKQ
YGDCLGDIAARDLICAQKENGLTVLPPLLTDEMIAQYTSALLAGTITSGWTFGAGPALQIPFPMQMAYRENGIGV
TQNVLYENQKLIANQFNSAIGKIQDSLSSTPSALGKLQDVVNQNAQALNTLVKQLSSNFGAISSVLNDILSRLDP
PEAEVQIDRLITGRLQSLQTYVTQQLIRAAEIRASANLAATKMSECVLGQSKRVDFCGKGYHLMSFPQSAPHGVV
FLHVTYVPAQEKNFTTAPAICHDGKAHFPREGVFVSNGTHWFVTQRNFYEPQIITTDNTFVSGNCDVVIGIVNNT
VYD PLQPELDSFKEELDKYFKNHTSPDVDLGDISGINASVVNIQKEIDRLNEVAKNLNESLIDLQELGKYEQ (SEQ ID NO: 133)
(QC)VNLTTRTQLPPAYTNSFTRGVYYPDKVFRSSVLHSTQDLFLPFFSNVTWFHAIHVSGTNGTKREDNPVLPF
NDGVYFASTEKSNIIRGWIFGTTLDSKTQSLLIVNNATNVVIKVCEFQFCNDPFLGVYYHKNNKSWMESEFRVYS
SANNCTFEYVSQPFLMDLEGKQGNEKNLREFVEKNIDGYFKIYSKHTPINLVRDLPQGESALEPLVDLPIGINIT
RFQTLLALHRSYLTPGDSSSGWTAGAAAYYVGYLQPRTELLKYNENGTITDAVDCALDPLSETKCTLKSFTVEKG
IYQTSNFRVQPTESIVRFPNITNLCPFGEVENATRFASVYAWNRKRISNCVADYSVLYNSASFSTFKCYGVSPTK
LNDLCFTNVYADSFVIRGDEVRQIAPGQTGKIADYNYKLPDDFTGCVIAWNSNNLDSKVGGNYNYLYRLERKSNL
KPFERDISTEIYQAGSTPCNGVEGENCYFPLQSYGFQPTNGVGYQPYRVVVLSFELLHAPATVCGPKKSTNLVKN
KCVNFNFNGLTGTGVLTESNKKELPFQQFGRDIADTTDAVRDPQTLEILDITPCSFGGVSVITPGTNTSNQVAVL
YQDVNCTEVPVAIHADQLTPTWRVYSTGSNVFQTRAGCLIGAEHVNNSYECDIPIGAGICASYQTQTNSPGSASS
VASQSIIAYTMSLGAENSVAYSNNSIAIPTNFTISVTTEILPVSMTKTSVDCTMYICGDSTECSNLLLQYGSFCT
QLNRALTGIAVEQDKNTQEVFAQVKQIYKTPPIKDFGGENESQILPDPSKPSKRSPIEDLLENKVTLADAGFIKQ
YGDCLGDIAARDLICAQKENGLTVLPPLLTDEMIAQYTSALLAGTITSGWTFGAGPALQIPFPMQMAYRENGIGV
TQNVLYENQKLIANQFNSAIGKIQDSLSSTPSALGKLQDVVNQNAQALNTLVKQLSSNFGAISSVLNDILSRLDP
PEAEVQIDRLITGRLQSLQTYVTQQLIRAAEIRASANLAATKMSECVLGQSKRVDFCGKGYHLMSFPQSAPHGVV
FLHVTYVPAQEKNFTTAPAICHDGKAHFPREGVFVSNGTHWFVTQRNFYEPQIITTDNTFVSGNCDVVIGIVNNT
VYDPLQPELDSFKEELDKYFKNHT (SEQ ID NO: 134)
VNLTTRTQLPPAYTNSFTRGVYYPDKVFRSSVLHSTQDLFLPFFSNVTWFHAIHVSGTNGTKREDNPVLPENDGV
YFASTEKSNIIRGWIFGTTLDSKTQSLLIVNNATNVVIKVCEFQFCNDPFLGVYYHKNNKSWMESEFRVYSSANN
CTFEYVSQPFLMDLEGKQGNEKNLREFVEKNIDGYFKIYSKHTPINLVRDLPQGESALEPLVDLPIGINITRFQT
LLALHRSYLTPGDSSSGWTAGAAAYYVGYLQPRTELLKYNENGTITDAVDCALDPLSETKCTLKSFTVEKGIYQT
SNFRVQPTESIVRFPNITNLCPFGEVENATRFASVYAWNRKRISNCVADYSVLYNSASFSTFKCYGVSPTKLNDL
CFTNVYADSFVIRGDEVRQIAPGQTGKIADYNYKLPDDFTGCVIAWNSNNLDSKVGGNYNYLYRLFRKSNLKPFE
RDISTEIYQAGSTPCNGVEGENCYFPLQSYGFQPTNGVGYQPYRVVVLSFELLHAPATVCGPKKSTNLVKNKCVN -continued FNFNGLTGTGVLTESNKKELPFQQFGRDIADTTDAVRDPQTLEILDITPCSFGGVSVITPGTNTSNQVAVLYQDV
NCTEVPVAIHADQLTPTWRVYSTGSNVFQTRAGCLIGAEHVNNSYECDIPIGAGICASYQTQTNSPGSASSVASQ
SIIAYTMSLGAENSVAYSNNSIAIPTNFTISVTTEILPVSMTKTSVDCTMYICGDSTECSNLLLQYGSFCTQLNR
ALTGIAVEQDKNTQEVFAQVKQIYKTPPIKDFGGENFSQILPDPSKPSKRSPIEDLLENKVTLADAGFIKQYGDC
LGDIAARDLICAQKENGLTVLPPLLTDEMIAQYTSALLAGTITSGWTFGAGPALQIPFPMQMAYRENGIGVTQNV
LYENQKLIANQFNSAIGKIQDSLSSTPSALGKLQDVVNQNAQALNTLVKQLSSNFGAISSVLNDILSRLDPPEAE
VQIDRLITGRLQSLQTYVTQQLIRAAEIRASANLAATKMSECVLGQSKRVDFCGKGYHLMSFPQSAPHGVVFLHV
TYVPAQEKNFTTAPAICHDGKAHFPREGVFVSNGTHWFVTQRNFYEPQIITTDNTFVSGNCDVVIGIVNNTVYDP
LQPELDSFKEELDKYFKNHTSPDVDLGDISGINASVVNIQKEIDRLNEVAKNLNESLIDLQELGKYEQ (SEQ ID NO: 135)

VNLTTRTQLPPAYTNSFTRGVYYPDKVFRSSVLHSTQDLFLPFFSNVTWFHAIHVSGTNGTKRFDNPVLPENDGV
YFASTEKSNIIRGWIFGTTLDSKTQSLLIVNNATNVVIKVCEFQFCNDPFLGVYYHKNNKSWMESEFRVYSSANN
CTFEYVSQPFLMDLEGKQGNEKNLREFVEKNIDGYFKIYSKHTPINLVRDLPQGFSALEPLVDLPIGINITRFQT
LLALHRSYLTPGDSSSGWTAGAAAYYVGYLQPRTELLKYNENGTITDAVDCALDPLSETKCTLKSFTVEKGIYQT
SNFRVQPTESIVRFPNITNLCPFGEVENATRFASVYAWNRKRISNCVADYSVLYNSASFSTEKCYGVSPTKLNDL
CFTNVYADSFVIRGDEVRQIAPGQTGKIADYNYKLPDDFTGCVIAWNSNNLDSKVGGNYNYLYRLERKSNLKPFE
RDISTEIYQAGSTPCNGVEGENCYFPLQSYGFQPTNGVGYQPYRVVVLSFELLHAPATVCGPKKSTNLVKNKCVN
FNFNGLTGTGVLTESNKKELPFQQFGRDIADTTDAVRDPQTLEILDITPCSFGGVSVITPGTNTSNQVAVLYQDV
NCTEVPVAIHADQLTPTWRVYSTGSNVFQTRAGCLIGAEHVNNSYECDIPIGAGICASYQTQTNSPGSASSVASQ
SIIAYTMSLGAENSVAYSNNSIAIPTNFTISVTTEILPVSMTKTSVDCTMYICGDSTECSNLLLQYGSFCTQLNR
ALTGIAVEQDKNTQEVFAQVKQIYKTPPIKDFGGENFSQILPDPSKPSKRSPIEDLLENKVTLADAGFIKQYGDC
LGDIAARDLICAQKFNGLTVLPPLLTDEMIAQYTSALLAGTITSGWTFGAGPALQIPFPMQMAYRENGIGVTQNV
LYENQKLIANQFNSAIGKIQDSLSSTPSALGKLQDVVNQNAQALNTLVKQLSSNFGAISSVLNDILSRLDPPEAE
VQIDRLITGRLQSLQTYVTQQLIRAAEIRASANLAATKMSECVLGQSKRVDFCGKGYHLMSFPQSAPHGVVFLHV
TYVPAQEKNFTTAPAICHDGKAHFPREGVFVSNGTHWFVTQRNFYEPQIITTDNTFVSGNCDVVIGIVNNTVYDP
LQPELDSFKEELDKYFKNHT (SEQ ID NO: 136)

ETCTQCVNLTTRTQLPPAYTNSFTRGVYYPDKVFRSSVLHSTQDLFLPFFSNVTWFHAIHVSGTNGTKREDNPVL
PFNDGVYFASTEKSNIIRGWIFGTTLDSKTQSLLIVNNATNVVIKVCEFQFCNDPFLGVYYHKNNKSWMESEFRV
YSSANNCTFEYVSQPFLMDLEGKQGNEKNLREFVFKNIDGYFKIYSKHTPINLVRDLPQGFSALEPLVDLPIGIN
ITRFQTLLALHRSYLTPGDSSSGWTAGAAAYYVGYLQPRTELLKYNENGTITDAVDCALDPLSETKCTLKSFTVE
KGIYQTSNFRVQPTESIVRFPNITNLCPFGEVENATRFASVYAWNRKRISNCVADYSVLYNSASFSTEKCYGVSP
TKLNDLCFTNVYADSFVIRGDEVRQIAPGQTGKIADYNYKLPDDFTGCVIAWNSNNLDSKVGGNYNYLYRLERKS
NLKPFERDISTEIYQAGSTPCNGVEGENCYFPLQSYGFQPTNGVGYQPYRVVVLSFELLHAPATVCGPKKSTNLV
KNKCVNFNFNGLTGTGVLTESNKKELPFQQFGRDIADTTDAVRDPQTLEILDITPCSFGGVSVITPGTNTSNQVA
VLYQDVNCTEVPVAIHADQLTPTWRVYSTGSNVFQTRAGCLIGAEHVNNSYECDIPIGAGICASYQTQTNSPGSA
SSVASQSIIAYTMSLGAENSVAYSNNSIAIPTNFTISVTTEILPVSMTKTSVDCTMYICGDSTECSNLLLQYGSF
CTQLNRALTGIAVEQDKNTQEVFAQVKQIYKTPPIKDFGGFNFSQILPDPSKPSKRSPIEDLLENKVTLADAGFI
KQYGDCLGDIAARDLICAQKFNGLTVLPPLLTDEMIAQYTSALLAGTITSGWTFGAGPALQIPFPMQMAYRENGI
GVTQNVLYENQKLIANQFNSAIGKIQDSLSSTPSALGKLQDVVNQNAQALNTLVKQLSSNFGAISSVLNDILSRL
DPPEAEVQIDRLITGRLQSLQTYVTQQLIRAAEIRASANLAATKMSECVLGQSKRVDFCGKGYHLMSFPQSAPHG

-continued

VVFLHVTYVPAQEKNFTTAPAICHDGKAHFPREGVFVSNGTHWFVTQRNFYEPQIITTDNTFVSGNCDVVIGIVN

NTVYDPLQPELDSFKEELDKYFKNHTSPDVDLGDISGINASVVNIQKEIDRLNEVAKNLNESLIDLQELGKYEQ (SEQ ID NO: 137)

ETCTQCVNLTTRTQLPPAYTNSFTRGVYYPDKVFRSSVLHSTQDLFLPFFSNVTWFHAIHVSGTNGTKREDNPVL

PFNDGVYFASTEKSNIIRGWIFGTTLDSKTQSLLIVNNATNVVIKVCEFQFCNDPFLGVYYHKNNKSWMESEFRV

YSSANNCTFEYVSQPFLMDLEGKQGNEKNLREFVEKNIDGYFKIYSKHTPINLVRDLPQGFSALEPLVDLPIGIN

ITRFQTLLALHRSYLTPGDSSSGWTAGAAAYYVGYLQPRTELLKYNENGTITDAVDCALDPLSETKCTLKSFTVE

KGIYQTSNERVQPTESIVRFPNITNLCPFGEVENATRFASVYAWNRKRISNCVADYSVLYNSASFSTEKCYGVSP

TKLNDLCFTNVYADSFVIRGDEVRQIAPGQTGKIADYNYKLPDDFTGCVIAWNSNNLDSKVGGNYNYLYRLERKS

NLKPFERDISTEIYQAGSTPCNGVEGENCYFPLQSYGFQPTNGVGYQPYRVVVLSFELLHAPATVCGPKKSTNLV

KNKCVNFNFNGLTGTGVLTESNKKELPFQQFGRDIADTTDAVRDPQTLEILDITPCSFGGVSVITPGTNTSNQVA

VLYQDVNCTEVPVAIHADQLTPTWRVYSTGSNVFQTRAGCLIGAEHVNNSYECDIPIGAGICASYQTQTNSPGSA

SSVASQSIIAYTMSLGAENSVAYSNNSIAIPTNFTISVTTEILPVSMTKTSVDCTMYICGDSTECSNLLLQYGSF

CTQLNRALTGIAVEQDKNTQEVFAQVKQIYKTPPIKDFGGENFSQILPDPSKPSKRSPIEDLLENKVTLADAGFI

KQYGDCLGDIAARDLICAQKENGLTVLPPLLTDEMIAQYTSALLAGTITSGWTFGAGPALQIPFPMQMAYRENGI

GVTQNVLYENQKLIANQFNSAIGKIQDSLSSTPSALGKLQDVVNQNAQALNTLVKQLSSNFGAISSVLNDILSRL

DPPEAEVQIDRLITGRLQSLQTYVTQQLIRAAEIRASANLAATKMSECVLGQSKRVDFCGKGYHLMSFPQSAPHG

VVFLHVTYVPAQEKNFTTAPAICHDGKAHFPREGVFVSNGTHWFVTQRNFYEPQIITTDNTFVSGNCDVVIGIVN

NTVYDPLQPELDSFKEELDKYFKNHT

In one specific embodiment, X1 in at least 20%, 30%, 40%, 50%, 60%, 70%, 80%, 90%, or 100% of the second proteins comprises an amino acid sequence having at least 75%, 80%, 85%, 90%, 91%, 92%, 93%, 94%, 95%, 96%, 97%, 98%, 99%, or 100% amino acid sequence identity to the amino acid sequence of SEQ ID NO: 125, the SARS-COV-2 RBD provided as exemplary embodiments in the examples that follow. In various embodiments, X1 in at least 20%, 30%, 40%, 50%, 60%, 70%, 80%, 90%, or 100% of the second proteins comprise mutations at 1, 2, 3, 4, 5, 6, 7, or all 8 positions relative to SEQ ID NO: 125 selected from the group consisting of K90N, K90T, G119S, Y126F, T151I, E157K, E157A, S167P, N174Y, and L125R, including but not limited to mutations comprising one of the following naturally occurring mutations or combinations of mutations:

N174Y (UK variant);

K90N/E157K/N174Y (South African variant);

K90N or T/E157K/N174Y (Brazil variant); or

L125R (LA variant).

The amino acid residue numbering of these naturally occurring variants is based on their position within SEQ ID NO: 125, while they are generally described based on their residue number in the Spike protein (i.e.: K417 in spike=K90 in RBD; G446 in spike=G119 in RBD; L452 in spike=L125 in RBD; Y453 in spike=Y126 in RBD; T478 in spike=T151 in RBD; E484 in spike=E157 in RBD; S494 in spike=S167 in RBD; N501 in spike=N174 in RBD).

In various further embodiments, X1 in at least 20%, 30%, 40%, 50%, 60%, 70%, 80%, 90%, or 100% of the second proteins comprise mutations at 1, 2, 3, 4, 5, 6, 7, or all 8 positions relative to SEQ ID NO:130 selected from the group consisting of L18F, T20N, P26S, deletion of residues 69-70, D80A, D138Y, R190S, D215G, K417N, K417T, G446S, L452R, Y453F, T478I, E484K, S494P, N501Y, A570D, D614G, H655Y, P681H, A701V, T716L including but not limited to mutations comprising one of the following naturally occurring mutations or combinations of mutations:

N501Y, optionally further including 1, 2, 3, 4, or 5 of deletion of one or both of residues 69-70, A570D, D614G, P681H, and/or T716L (UK variant);

K417N/E484K/N501Y, optionally further including 1, 2, 3, 4, or 5 of L18F, D80A, D215G, D614G, and/or A701V (South African variant);

K417N or T/E484K/N501Y, optionally further including 1, 2, 3, 4, or 5 of L18F, T20N, P26S, D138Y, R190S, D614G, and/or H655Y (Brazil variant); or L452R (LA variant).

As will be understood by those of skill in the art, when X1 comprises an amino acid sequence having at least 75%, 80%, 85%, 90%, 91%, 92%, 93%, 94%, 95%, 96%, 97%, 98%, 99%, or 100% amino acid sequence identity to the amino acid sequence of SEQ ID NO: 125 (or any other disclosed antigen), it may include additional amino acids at the amino- or carboxy-terminus. Thus, for example, when X1 comprises an amino acid sequence having at least 75%, 80%, 85%, 90%, 91%, 92%, 93%, 94%, 95%, 96%, 97%, 98%, 99%, or 100% amino acid sequence identity to the amino acid sequence of SEQ ID NO: 125, X1 may comprise the amino acid sequence of SEQ ID NO:126, which includes additional amino acids at its N-terminus relative to SEQ ID NO:125.

In a further embodiment, X1 in at least 20%, 30%, 40%, 50%, 60%, 70%, 80%, 90%, or 100% of the second proteins comprise 1, 2, 3, or all 4 mutations relative to SEQ ID NO: 125 selected from the group consisting of K90N, K90T, E157K, and N174Y.

The plurality of second assemblies may in total comprise a single SARS-COV-2 antigen, or may comprise 2 or more different SARS-COV-2 antigen. In one embodiment, the plurality of second assemblies in total comprises 2, 3, 4, 5, 6, 7, 8, or more different SARS-CoV-2 antigens. In one exemplary such embodiment, the plurality of second assemblies in total comprise 2, 3, 4, 5, 6, 7, 8, or more polypeptides comprising the amino acid sequence of any one of SEQ ID NOS: 1-84.

In one embodiment, X1 in at least 20%, 30%, 40%, 50%, 60%, 70%, 80%, 90%, or 100% of the second proteins comprises the amino acid sequence of SEQ ID NO:125. In another embodiment, X1 in 100% of the second proteins comprises the amino acid sequence of SEQ ID NO: 125, and all second proteins are identical.

In a further embodiment, all second assemblies comprise at least one second protein comprising the amino acid sequence of any one of SEQ ID NOS: 1-84. In another embodiment, all second proteins comprise the amino acid sequence of any one of SEQ ID NOS: 1-84.

The nanoparticles comprise a plurality of identical first proteins. In one embodiment, the first protein comprises an amino acid sequence at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or some (i.e.: 1, 2, 3, 4, 5, 6, or more) or all of the optional residues may be absent. In a specific embodiment, the first protein comprises an amino acid sequence at least 75%, 80%, 85%, 90%, 91%, 92%, 93%, 94%, 95%, 96%, 97%, 98%, 99%, or 100% identical to the amino acid sequence of SEQ ID NO:155.

| Name | Amino Acid Sequence | Identified interface residues | Surface residues not near interface |
|---|---|---|---|
| I53-50B SEQ ID NO: 152 | (M)NQHSHKDYETVRIAVVRARWHAEIVDACVSAFEAAMADIGGDRFAVDVEDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAA | I53-50B: 24,28,36,124, 125, 127, 128, 129, 131, 132, 133, 135, 139 | I53-50B: 6, 7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53-50B.1 SEQ ID NO: 153 | (M)NQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHRYRDSDAHTLLFLALFAVKGMEAARACVEILAAREKIAA | I53-50B: 24,28,36,124,125, 127, 128, 129, 131, 132, 133, 135, 139 | I53-50B: 6, 7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53-50B.1NegT2 SEQ ID NO: 154 | (M)NQHSHKDHETVRIAVVRARWHAEIVDACVSAFEAAMRDIGGDRFAVDVFDVPGAYEIPLHARTLAETGRYGAVLGTAFVVDGGIYDHEFVASAVIDGMMNVQLDTGVPVLSAVLTPHEYEDSDADTLLFLALFAVKGMEAARACVEILAAREKIAA | I53-50B: 24, 28, 36, 124, 125, 127, 128, 129, 131, 132, 133, 135, 139 | I53-50B: 6,7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53-50B.4PosT1 SEQ ID NO: 155 | (M)NQHSHKDHETVRIAVVRARWHAEIVDACVSAFEAAMRDIGGDRFAVDVEDVPGAYEIPLHARTLAETGRYGAVLGTAFVVNGGIYRHEFVASAVINGMMNVQLNTGVPVLSAVLTPHNYDKSKAHTLLFLALFAVKGMEAARACVEILAAREKIAA | I53-50B: 24, 28, 36, 124, 125, 128, 129, 131, 132, 133, 135, 139 | I53-50B: 6,7,8, 9, 10, 11, 13, 18, 20, 21, 34, 38, 39, 40, 43, 44, 48, 51, 63, 67, 70, 87, 101, 105, 118, 143, 147, 152, 153, 154 |

I53-50-v4 pentameric component
(MGSSHHHHHHSSGLVPRGSEQKLISEEDLGS)NQHSQKDQETVRIAVVRARWHAFIVDACVSAFEAAMRKIGGERFAVDVFDVPGAYEIPLHARTLAKTGRYGAVLGTAFVVNGGIYRHEFVASAVIDGMMNVQLDTGVPVLSAVLTPHNYDKSNAKTLLFLALFAVKGMEAARACVEILAAREKIAA(GSLEGS) (SEQ ID NO: 156)

I53-5-v1 pentameric component B
(M)NQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSKAHTLLFLALFAVKGMEAARACVEILAAREKIAA(GS) (SEQ ID NO: 157)

I53-50-v2 pentameric component B
(M)NQHSHKDHETVRIAVVRARWHAFIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSNAKTLLFLALFAVKGMEAARACVEILAAREKIAA(GS) (SEQ ID NO: 158)

I53-50-v3 pentameric component B
(M)NQHSHKDHETVRIAVVRARWHAFIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSNAKTLLFLALFAVKGMEAARACVEILAAREKIAA(GS) (SEQ ID NO: 159)

In an exemplary embodiment, the first protein comprises the amino acid sequence of SEQ ID NO:155. In various further such embodiments, the at least one or a plurality (20, %, 33%, 40%, 50%, 75%, etc.) of the second assemblies comprises at least one second protein comprising the amino acid sequence selected from the group consisting of SEQ ID NO:85-88, or all second assemblies comprise at least one second protein comprising the amino acid sequence selected from the group consisting of SEQ ID NO:85-88.

In one specific embodiment, (a) the first protein comprises the amino acid sequence of SEQ ID NO:155;

(b) all second proteins comprise the amino acid sequence of SEQ ID NO:85, wherein X1 in at least 20%, 30%, 40%, 50%, 60%, 70%, 80%, 90%, or 100% of the second proteins comprise an amino acid sequence at least 75%, 80%, 85%, 90%, 91%, 92%, 93%, 94%, 95%, 96%, 97%, 98%, 99%, or 100% amino acid sequence identity to the amino acid sequence of SEQ ID NO: 125.

In another specific embodiment, (a) the first protein comprises the amino acid sequence of SEQ ID NO: 155;

(b) all second proteins comprise the amino acid sequence of SEQ ID NO:85, wherein X1 in at least 50%, 60%, 70%, 80%, 90%, or 100% of the second proteins comprise an amino acid sequence at least 75%, 80%, 85%, 90%, 91%, 92%, 93%, 94%, 95%, 96%, 97%, 98%, 99%, or 100% amino acid sequence identity to the amino acid sequence of SEQ ID NO: 125.

In a further specific embodiment:

(a) the first protein comprises the amino acid sequence of SEQ ID NO:155;

(b) all second proteins comprise the amino acid sequence selected from the group consisting of SEQ ID NO: 1-8.

In one specific embodiment:

(a) the first protein comprises the amino acid sequence of SEQ ID NO:155;

(b) all second proteins comprise the amino acid sequence of SEQ ID NO:1 or 5.

The disclosure further provides compositions, comprising a plurality of nanoparticles of any embodiment or combination of embodiments of the disclosure. In one embodiment, the compositions comprise a plurality of nanoparticles of the specific embodiments disclosed above.

In a fourth aspect, the disclosure provides nucleic acids encoding a polypeptide or fusion protein of the disclosure. The nucleic acid sequence may comprise RNA (such as mRNA) or DNA. Such nucleic acid sequences may comprise additional sequences useful for promoting expression and/or purification of the encoded protein, including but not limited to polyA sequences, modified Kozak sequences, and sequences encoding epitope tags, export signals, and secretory signals, nuclear localization signals, and plasma membrane localization signals. It will be apparent to those of skill in the art, based on the teachings herein, what nucleic acid sequences will encode the proteins of the invention.

In a fifth aspect, disclosure provides expression vectors comprising the isolated nucleic acid of any embodiment or combination of embodiments of the disclosure operatively linked to a suitable control sequence. "Expression vector" includes vectors that operatively link a nucleic acid coding region or gene to any control sequences capable of effecting expression of the gene product. "Control sequences" operably linked to the nucleic acid sequences of the disclosure are nucleic acid sequences capable of effecting the expression of the nucleic acid molecules. The control sequences need not be contiguous with the nucleic acid sequences, so long as they function to direct the expression thereof. Thus, for example, intervening untranslated yet transcribed sequences can be present between a promoter sequence and the nucleic acid sequences and the promoter sequence can still be considered "operably linked" to the coding sequence. Other such control sequences include, but are not limited to, polyadenylation signals, termination signals, and ribosome binding sites. Such expression vectors can be of any type known in the art, including but not limited to plasmid and viral-based expression vectors. The control sequence used to drive expression of the disclosed nucleic acid sequences in a mammalian system may be constitutive (driven by any of a variety of promoters, including but not limited to, CMV, SV40, RSV, actin, EF) or inducible (driven by any of a number of inducible promoters including, but not limited to, tetracycline, ecdysone, steroid-responsive).

In a sixth aspect, the present disclosure provides cells comprising the polypeptide, the nanoparticle, the composition, the nucleic acid, and/or the expression vector of any embodiment or combination of embodiments of the disclosure, wherein the cells can be either prokaryotic or eukaryotic, such as mammalian cells. In one embodiment the cells may be transiently or stably transfected with the nucleic acids or expression vectors of the disclosure. Such transfection of expression vectors into prokaryotic and eukaryotic cells can be accomplished via any technique known in the art. A method of producing a polypeptide according to the invention is an additional part of the invention. The method comprises the steps of (a) culturing a host according to this aspect of the invention under conditions conducive to the expression of the polypeptide, and (b) optionally, recovering the expressed polypeptide.

In a seventh aspect, the disclosure provides pharmaceutical compositions/vaccines comprising (a) the polypeptide, the nanoparticle, the composition, the nucleic acid, the expression vector, and/or the cell of embodiment or combination of embodiments herein; and (b) a pharmaceutically acceptable carrier.

As shown in the examples that follow, the nanoparticle immunogens elicit potent and protective antibody responses against SARS-COV-2. The nanoparticle vaccines of the disclosure induce neutralizing antibody titers roughly ten-fold higher than the prefusion-stabilized S ectodomain trimer despite a more than five-fold lower dose. Antibodies elicited by the nanoparticle immunogens target multiple distinct epitopes, suggesting that they may not be easily susceptible to escape mutations, and exhibit a significantly lower binding: neutralizing ratio than convalescent human sera, which may minimize the risk of vaccine-associated enhanced respiratory disease.

The compositions/vaccines may further comprise (a) a lyoprotectant; (b) a surfactant; (c) a bulking agent; (d) a tonicity adjusting agent; (e) a stabilizer; (f) a preservative and/or (g) a buffer. In some embodiments, the buffer in the pharmaceutical composition is a Tris buffer, a histidine buffer, a phosphate buffer, a citrate buffer or an acetate buffer. The composition may also include a lyoprotectant, e.g. sucrose, sorbitol or trehalose. In certain embodiments, the composition includes a preservative e.g. benzalkonium chloride, benzethonium, chlorohexidine, phenol, m-cresol, benzyl alcohol, methylparaben, propylparaben, chlorobutanol, o-cresol, p-cresol, chlorocresol, phenylmercuric nitrate, thimerosal, benzoic acid, and various mixtures thereof. In other embodiments, the composition includes a bulking agent, like glycine. In yet other embodiments, the composition includes a surfactant e.g., polysorbate-20, polysorbate-40, polysorbate-60, polysorbate-65, polysorbate-80 polysorbate-85, poloxamer-188, sorbitan monolaurate, sorbitan monopalmitate, sorbitan monostearate, sorbitan monooleate, sorbitan trilaurate, sorbitan tristearate, sorbitan trioleaste, or a combination thereof. The composition may also include a tonicity adjusting agent, e.g., a compound that renders the formulation substantially isotonic or isoosmotic with human blood. Exemplary tonicity adjusting agents include sucrose, sorbitol, glycine, methionine, mannitol, dextrose, inositol, sodium chloride, arginine and arginine hydrochloride. In other embodiments, the composition additionally includes a stabilizer, e.g., a molecule which substantially prevents or reduces chemical and/or physical instability of the nanostructure, in lyophilized or liquid form. Exemplary stabilizers include sucrose, sorbitol, glycine, inositol, sodium chloride, methionine, arginine, and arginine hydrochloride.

The nanoparticles may be the sole active agent in the composition, or the composition may further comprise one or more other agents suitable for an intended use, including but not limited to adjuvants to stimulate the immune system generally and improve immune responses overall. Any suitable adjuvant can be used. The term "adjuvant" refers to a compound or mixture that enhances the immune response to an antigen. Exemplary adjuvants include, but are not limited to, Adju-Phos™, Adjumer™, albumin-heparin microparticles, Algal Glucan, Algammulin, Alum, Antigen Formulation, AS-2 adjuvant, autologous dendritic cells, autologous PBMC, Avridine™, B7-2, BAK, BAY R1005, Bupivacaine, Bupivacaine-HCl, BWZL, Calcitriol, Calcium Phosphate Gel, CCR5 peptides, CFA, Cholera holotoxin (CT) and Cholera toxin B subunit (CTB), Cholera toxin A1-subunit-Protein A D-fragment fusion protein, CpG, CRL1005, Cytokine-containing Liposomes, D-Murapalmitine, DDA, DHEA, Diphtheria toxoid, DL-PGL, DMPC, DMPG, DOC/Alum Complex, Fowlpox, Freund's Complete Adjuvant, Gamma Inulin, Gerbu Adjuvant, GM-CSF, GMDP, hGM-CSF, hIL-12 (N222L), hTNF-alpha, IFA, IFN-gamma in pcDNA3, IL-12 DNA, IL-12 plasmid, IL-12/GMCSF plasmid (Sykes), IL-2 in pcDNA3, IL-2/Ig plasmid, IL-2/Ig protein, IL-4, IL-4 in pcDNA3, Imiquimod™, ImmTher™, Immunoliposomes Containing Antibodies to Costimulatory Molecules, Interferon-gamma, Interleukin-1 beta, Interleukin-12, Interleukin-2, Interleukin-7, ISCOM(s)™, Iscoprep 7.0.3™, Keyhole Limpet Hemocyanin, Lipid-based Adjuvant, Liposomes, Loxoribine, LT (R192G), LT-OA or LT Oral Adjuvant, LT-R192G, LTK63, LTK72, MF59, MONTANIDE ISA 51, MONTANIDE ISA 720, MPL™, MPL-SE, MTP-PE, MTP-PE Liposomes, Murametide, Murapalmitine, NAGO, nCT native Cholera Toxin, Non-Ionic Surfactant Vesicles, non-toxic mutant E112K of Cholera Toxin mCT-E112K, p-Hydroxybenzoique acid methyl ester, pCIL-10, pCIL12, pCMVmCAT1, pCMVN, Peptomer-NP, Pleuran, PLG, PLGA, PGA, and PLA, Pluronic L121, PMMA, PODDS™, Poly rA: Poly rU, Polysorbate 80, Protein Cochleates, QS-21, Quadri A saponin, Quil-A, Rehydragel HPA, Rehydragel LV, RIBI, Ribilike adjuvant system (MPL, TMD, CWS), S-28463, SAF-1, Sclavo peptide, Sendai Proteoliposomes, Sendai-containing Lipid Matrices, Span 85, Specol, Squalane 1, Squalene 2, Stearyl Tyrosine, Tetanus toxoid (TT), Theramide™, Threonyl muramyl dipeptide (TMDP), Ty Particles, and Walter Reed Liposomes. Selection of an adjuvant depends on the subject to be treated. Preferably, a pharmaceutically acceptable adjuvant is used.

In an eighth aspect, the disclosure provides methods to treat or limit development of a SARS-COV-2 infection, comprising administering to a subject in need thereof an amount effective to treat or limit development of the infection of the polypeptide, nanoparticle, composition, nucleic acid, pharmaceutical composition, or vaccine of any embodiment herein (referred to as the "immunogenic composition"). The subject may be any suitable mammalian subject, including but not limited to a human subject.

When the method comprises limiting a SARS-COV-2 infection, the immunogenic composition is administered prophylactically to a subject that is not known to be infected, but may be at risk of exposure to SARS-COV-2. As used herein, "limiting development" includes, but is not limited to accomplishing one or more of the following: (a) generating an immune response (antibody and/or cell-based) to of SARS-COV-2 in the subject; (b) generating neutralizing antibodies against SARS-COV-2 in the subject (b) limiting build-up of SARS-COV-2 titer in the subject after exposure to SARS-COV-2; and/or (c) limiting or preventing development of SARS-COV-2 symptoms after infection. Exemplary symptoms of SARS-COV-2 infection include, but are not limited to, fever, fatigue, cough, shortness of breath, chest pressure and/or pain, loss or diminution of the sense of smell, loss or diminution of the sense of taste, and respiratory issues including but not limited to pneumonia, bronchitis, severe acute respiratory syndrome (SARS), and upper and lower respiratory tract infections.

In one embodiment, the methods generate an immune response in a subject in the subject not known to be infected with SARS-COV-2, wherein the immune response serves to limit development of infection and symptoms of a SARS-COV-2 infection. In one embodiment, the immune response comprises generation of neutralizing antibodies against SARS-COV-2. In an exemplary such embodiment, the immune response comprises generation of SARS-COV-2 spike protein antibody-specific responses with a mean geometric titer of at least $1\times10^5$. In a further embodiment, the immune response comprises generation of antibodies against multiple antigenic epitopes.

As used herein, an "effective amount" refers to an amount of the immunogenic composition that is effective for treating and/or limiting SARS-COV-2 infection. The polypeptide, nanoparticle, composition, nucleic acid, pharmaceutical composition, or vaccine of any embodiment herein are typically formulated as a pharmaceutical composition, such as those disclosed above, and can be administered via any suitable route, including orally, parentally, by inhalation spray, rectally, or topically in dosage unit formulations containing conventional pharmaceutically acceptable carriers, adjuvants, and vehicles. The term parenteral as used herein includes, subcutaneous, intravenous, intra-arterial, intramuscular, intrasternal, intratendinous, intraspinal, intracranial, intrathoracic, infusion techniques or intraperitoneally. Polypeptide compositions may also be administered via microspheres, liposomes, immune-stimulating complexes (ISCOMs), or other microparticulate delivery systems or sustained release formulations introduced into suitable tissues (such as blood). Dosage regimens can be adjusted to provide the optimum desired response (e.g., a therapeutic or prophylactic response). A suitable dosage range may, for instance, be 0.1 μg/kg-100 mg/kg body weight of the polypeptide or nanoparticle thereof. The composition can be delivered in a single bolus, or may be administered more than once (e.g., 2, 3, 4, 5, or more times) as determined by attending medical personnel.

In one embodiment, the administering comprises administering a first dose and a second dose of the immunogenic composition, wherein the second dose is administered about 2 weeks to about 12 weeks, or about 4 weeks to about 12 weeks after the first does is administered. In various further embodiments, the second dose is administered about 2, 3, 4, 5, 6, 7, 8, 9, 10, 11, or 12 weeks after the first dose. In another embodiment, three doses may be administered, with a second dose administered about 1, 2, 3, 4, 5, 6, 7, 8, 9, 10, 11, or 12 weeks after the first dose, and the third dose administered about 1, 2, 3, 4, 5, 6, 7, 8, 9, 10, 11, or 12 weeks after the second dose.

In various other embodiments of prime-boost dosing, the administering comprises (a) administering a prime dose to the subject of a DNA, mRNA, or adenoviral vector vaccine, wherein the DNA, mRNA, or adenoviral vector vaccine encodes an amino acid sequence having at least 75%, 80%, 85%, 90%, 91%, 92%, 93%, 94%, 95%, 96%, 97%, 98%, 99%, or 100% amino acid sequence identity to the amino acid sequence of SEQ ID NO: 125-137; and (b) administering a boost dose to the subject of the polypeptide, nanoparticle, composition, nucleic acid, pharmaceutical composition, or vaccine of any embodiment or combination disclosed herein.

In an alternative embodiment, the administering comprises (a) administering a prime dose to the subject of any embodiment or combination disclosed herein; and (b) administering a boost dose to the subject of a DNA, mRNA, or adenoviral vector vaccine, wherein the DNA, mRNA, or adenoviral vector vaccine encodes an amino acid sequence having at least 75%, 80%, 85%, 90%, 91%, 92%, 93%, 94%, 95%, 96%, 97%, 98%, 99%, or 100% amino acid sequence identity to the amino acid sequence of SEQ ID NO: 125-137.

In either of these embodiments, any suitable DNA, RNA, or adenoviral vector vaccine may be used in conjunction with the immunogenic compositions of the present disclosure, including but not limited to vaccines to be developed as well as those available from Moderna, Pfizer/BioNTech, Johnson & Johnson, etc.

In another embodiment of the methods, the subject is infected with a severe acute respiratory (SARS) virus, including but not limited to SARS-COV-2, wherein the administering elicits an immune response against the SARS virus in the subject that treats a SARS virus infection in the subject. When the method comprises treating a SARS-COV-2 infection, the immunogenic compositions are administered to a subject that has already been infected with SARS-COV-2, and/or who is suffering from symptoms (as described above) indicating that the subject is likely to have been infected with SARS-COV-2.

As used herein, "treat" or "treating" includes, but is not limited to accomplishing one or more of the following: (a) reducing SARS-COV-2 titer in the subject; (b) limiting any increase of SARS-COV-2 titer in the subject; (c) reducing the severity of SARS-COV-2 symptoms; (d) limiting or preventing development of SARS-COV-2 symptoms after infection; (e) inhibiting worsening of SARS-COV-2 symptoms; (f) limiting or preventing recurrence of SARS-COV-2 symptoms in subjects that were previously symptomatic for SARS-COV-2 infection; and/or (e) survival.

The disclosure further provides kits, which may be used to prepare the nanoparticles and compositions of the disclosure. In one embodiment, the kits comprise:

(a) the polypeptide of any embodiment or combination of embodiments disclosed herein, such as in the first aspect; and (b) a first protein comprising an amino acid sequence at least at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or absent.

In one embodiment, the polypeptide comprises the amino acid sequence of SEQ ID NO: 1 or 5, and the first protein comprises the amino acid sequence of SEQ ID NO:155.

In another embodiment, the kits comprise:

(a) a nucleic acid encoding the polypeptide of any embodiment or combination of embodiments disclosed herein, such as in the first aspect; and (b) a nucleic acid encoding first protein comprising an amino acid sequence at least at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or absent.

In one embodiment, the polypeptide comprises the amino acid sequence of SEQ ID NO: 1 or 5, and the first protein comprises the amino acid sequence of SEQ ID NO: 155.

In a further embodiment, the kits comprise:

(a) an expression vector comprising a nucleic acid encoding the polypeptide any embodiment or combination of embodiments disclosed herein, such as in the first aspect, operatively linked to a suitable control sequence; and (b) an expression vector comprising a nucleic acid encoding first protein comprising an amino acid sequence at least at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or absent, wherein the nucleic acid is operatively linked to a suitable control sequence.

In one embodiment, the polypeptide comprises the amino acid sequence of SEQ ID NO: 1 or 5, and the first protein comprises the amino acid sequence of SEQ ID NO:155.

In another embodiment, the kits comprise:

(a) a cell comprising an expression vector, wherein the expression vector comprises a nucleic acid encoding the polypeptide any embodiment or combination of embodiments disclosed herein, such as in the first aspect, operatively linked to a suitable control sequence; and (b) a cell comprising an expression vector, wherein the expression vector comprises a nucleic acid encoding first protein comprising an amino acid sequence at least at least 75%, 80%, 85%, 90%, 91%, 92%, 93%, 94%, 95%, 96%, 97%, 98%, 99%, or 100% identical to the amino acid sequence selected the group consisting of SEQ ID NOS: 152-159, wherein residues in parentheses are optional and may be present or absent, wherein the nucleic acid is operatively linked to a suitable control sequence.

In one embodiment, the polypeptide comprises the amino acid sequence of SEQ ID NO: 1 or 5, and the first protein comprises the amino acid sequence of SEQ ID NO:155.

EXAMPLES

Elicitation of Potent Neutralizing Antibody Responses by Designed Protein Nanoparticle Vaccines for SARS-COV-2

Summary

A safe, effective, and scalable vaccine is urgently needed to halt the ongoing SARS-CoV-2 pandemic. Here, we describe the structure-based design of self-assembling protein nanoparticle immunogens that elicit potent and protective antibody responses against SARS-CoV-2 in mice. The nanoparticle vaccines display 60 copies of the SARS-COV-2 spike(S) glycoprotein receptor-binding domain (RBD) in a highly immunogenic array and induce neutralizing antibody titers roughly ten-fold higher than the prefusion-stabilized S ectodomain trimer despite a more than five-fold lower dose. Antibodies elicited by the nanoparticle immunogens target multiple distinct epitopes on the RBD, suggesting that they may not be easily susceptible to escape mutations, and exhibit a significantly lower binding: neutralizing ratio than convalescent human sera, which may minimize the risk of vaccine-associated enhanced respiratory disease. The high yield and stability of the protein components and assembled nanoparticles, especially compared to the SARS-COV-2 prefusion-stabilized S trimer, indicate that manufacture of the nanoparticle vaccines will be highly scalable.

Design, In Vitro Assembly, and Characterization of SARS-COV-2 RBD Nanoparticle Immunogens To design vaccine candidates that induce potent neutralizing Ab responses, we focused on the RBD of the SARS-COV-2 S glycoprotein (FIG. 1A-B). To overcome the limited immunogenicity of this small, monomeric antigen, we multivalently displayed the RBD on the exterior surface of the two-component protein nanoparticle I53-50. I53-50 is a computationally designed, 28 nm, 120-subunit complex with icosahedral symmetry constructed from trimeric (I53-50A) and pentameric (I53-50B) components (all amino acid sequences provided in Table 3). The nanoparticle can be assembled in vitro by simply mixing independently expressed and purified I53-50A and I53-50B. The RBD (residues 328-531) was genetically fused to I53-50A using linkers comprising 8, 12, or 16 glycine and serine residues (hereafter referred to as RBD-8GS-, RBD-12GS-, or RBD-16GS-I53-50A) to enable flexible presentation of the antigen extending from the nanoparticle surface (FIG. 1C). All RBD-I53-50A constructs were recombinantly expressed using mammalian (Expi293F) cells to ensure proper folding and glycosylation of the viral antigen. Initial yields of purified RBD-153-50A proteins (~30 mg purified protein per liter Expi293F cells) were ~20-fold higher than for the prefusion-stabilized S-2P trimer (Kirchdoerfer et al., 2018; Pallesen et al., 2017; Walls et al., 2020; Wrapp et al., 2020) (~1.5 mg/L), and increased to ~60 mg/L following promoter optimization. The RBD-I53-50A proteins were mixed with pentameric I53-50B purified from *E. coli* in a ~1:1 molar ratio (subunit: subunit) to initiate nanoparticle assembly (FIG. 1D).

TABLE 3

| Amino acid sequences of proteins used in this work (See FIGS. 1-6) |
|---|
| >RBD-8GS-I53-50A |
| MGILPSPGMPALLSLVSLLSVLLMGCVAETGTREPNITNLCPFGEVENATRFASVYAWNRKRISNCVADYSVL |
| YNSASFSTFKCYGVSPTKLNDLCFTNVYADSFVIRGDEVRQIAPGQTGKIADYNYKLPDDFTGCVIAWNSNNL |
| DSKVGGNYNYLYRLERKSNLKPFERDISTEIYQAGSTPCNGVEGENCYFPLQSYGFQPTNGVGYQPYRVVVLS |
| FELLHAPATVCGPKKSTGGSGGSGSEKAAKAEEAARKMEELFKKHKIVAVLRANSVEEAIEKAVAVFAGGVHL |
| IEITFTVPDADTVIKALSVLKEKGAIIGAGTVTSVEQARKAVESGAEFIVSPHLDEEISQFAKEKGVFYMPGV |
| MTPTELVKAMKLGHTILKLFPGEVVGPQFVKAMKGPFPNVKFVPTGGVNLDNVAEWFKAGVLAVGVGSALVKG |
| TPDEVREKAKAFVEKIRGATEGGSHHHHHHHH (SEQ ID NO: 14) |
| |
| >RBD-12GS-I53-50A |
| MGILPSPGMPALLSLVSLLSVLLMGCVAETGTREPNITNLCPFGEVENATRFASVYAWNRKRISNCVADYSVL |
| YNSASFSTFKCYGVSPTKLNDLCFTNVYADSFVIRGDEVRQIAPGQTGKIADYNYKLPDDFTGCVIAWNSNNL |
| DSKVGGNYNYLYRLERKSNLKPFERDISTEIYQAGSTPCNGVEGENCYFPLQSYGFQPTNGVGYQPYRVVVLS |
| FELLHAPATVCGPKKSTGSGSGGSGGSGSEKAAKAEEAARKMEELFKKHKIVAVLRANSVEEAIEKAVAVEAG |
| GVHLIEITFTVPDADTVIKALSVLKEKGAIIGAGTVTSVEQARKAVESGAEFIVSPHLDEEISQFAKEKGVFY |
| MPGVMTPTELVKAMKLGHTILKLFPGEVVGPQFVKAMKGPFPNVKFVPTGGVNLDNVAEWFKAGVLAVGVGSA |
| LVKGTPDEVREKAKAFVEKIRGATEGGSHHHHHHHH (SEQ ID NO: 22) |
| |
| >RBD-16GS-I53-50A |
| MGILPSPGMPALLSLVSLLSVLLMGCVAETGTREPNITNLCPFGEVENATRFASVYAWNRKRISNCVADYSVL |
| YNSASFSTFKCYGVSPTKLNDLCFTNVYADSFVIRGDEVRQIAPGQTGKIADYNYKLPDDETGCVIAWNSNNL |
| DSKVGGNYNYLYRLERKSNLKPFERDISTEIYQAGSTPCNGVEGENCYFPLQSYGFQPTNGVGYQPYRVVVLS |
| FELLHAPATVCGPKKSTGGSGGSGSGGSGGSGSEKAAKAEEAARKMEELFKKHKIVAVLRANSVEEAIEKAVA |
| VFAGGVHLIEITFTVPDADTVIKALSVLKEKGAIIGAGTVTSVEQARKAVESGAEFIVSPHLDEEISQFAKEK |
| GVFYMPGVMTPTELVKAMKLGHTILKLFPGEVVGPQFVKAMKGPFPNVKFVPTGGVNLDNVAEWEKAGVLAVG |
| VGSALVKGTPDEVREKAKAFVEKIRGATEGGSHHHHHHHH (SEQ ID NO; 2) |
| |
| >Monomeric SARS-CoV-2 RBD |
| MGILPSPGMPALLSLVSLLSVLLMGCVAETGTREPNITNLCPFGEVENATRFASVYAWNRKRISNCVADYSVL |
| YNSASFSTFKCYGVSPTKLNDLCFTNVYADSFVIRGDEVRQIAPGQTGKIADYNYKLPDDFTGCVIAWNSNNL |
| DSKVGGNYNYLYRLERKSNLKPFERDISTEIYQAGSTPCNGVEGENCYFPLQSYGFQPTNGVGYQPYRVVVLS |
| FELLHAPATVCGPKKSTHHHHHHHH (SEQ ID NO: 160) |
| |
| >SARS-CoV-2 S-2P Trimer |
| MGILPSPGMPALLSLVSLLSVLLMGCVAETGTQCVNLTTRTQLPPAYTNSFTRGVYYPDKVERSSVLHSTQDL |
| FLPFFSNVTWFHAIHVSGTNGTKRFDNPVLPENDGVYFASTEKSNIIRGWIFGTTLDSKTQSLLIVNNATNVV |
| IKVCEFQFCNDPFLGVYYHKNNKSWMESEFRVYSSANNCTFEYVSQPFLMDLEGKQGNEKNLREFVEKNIDGY |
| FKIYSKHTPINLVRDLPQGFSALEPLVDLPIGINITRFQTLLALHRSYLTPGDSSSGWTAGAAAYYVGYLQPR |
| TFLLKYNENGTITDAVDCALDPLSETKCTLKSFTVEKGIYQTSNERVQPTESIVRFPNITNLCPFGEVENATR |
| FASVYAWNRKRISNCVADYSVLYNSASFSTFKCYGVSPTKLNDLCFTNVYADSFVIRGDEVRQIAPGQTGKIA |
| DYNYKLPDDFTGCVIAWNSNNLDSKVGGNYNYLYRLFRKSNLKPFERDISTEIYQAGSTPCNGVEGENCYFPL |

TABLE 3-continued

Amino acid sequences of proteins used in this work (See FIGS. 1-6)

QSYGFQPTNGVGYQPYRVVVLSFELLHAPATVCGPKKSTNLVKNKCVNENENGLTGTGVLTESNKKELPFQQF
GRDIADTTDAVRDPQTLEILDITPCSFGGVSVITPGTNTSNQVAVLYQDVNCTEVPVAIHADQLTPTWRVYST
GSNVFQTRAGCLIGAEHVNNSYECDIPIGAGICASYQTQTNSPSGAGSVASQSIIAYTMSLGAENSVAYSNNS
IAIPTNFTISVTTEILPVSMTKTSVDCTMYICGDSTECSNLLLQYGSFCTQLNRALTGIAVEQDKNTQEVFAQ
VKQIYKTPPIKDFGGFNFSQILPDPSKPSKRSFIEDLLENKVTLADAGFIKQYGDCLGDIAARDLICAQKENG
LTVLPPLLTDEMIAQYTSALLAGTITSGWTFGAGAALQIPFAMQMAYRENGIGVTQNVLYENQKLIANQENSA
IGKIQDSLSSTASALGKLQDVVNQNAQALNTLVKQLSSNFGAISSVLNDILSRLDPPEAEVQIDRLITGRLQS
LQTYVTQQLIRAAEIRASANLAATKMSECVLGQSKRVDFCGKGYHLMSFPQSAPHGVVFLHVTYVPAQEKNFT
TAPAICHDGKAHFPREGVFVSNGTHWFVTQRNFYEPQIITTDNTFVSGNCDVVIGIVNNTVYDPLQPELDSEK
EELDKYFKNHTSPDVDLGDISGINASVVNIQKEIDRLNEVAKNLNESLIDLQELGKYEQYIKGSGRENLYFQG
GGGSGYIPEAPRDGQAYVRKDGEWVLLSTFLGHHHHHHHH (SEQ ID NO: 161)

>hACE2 (R518G) -Fc
MARAWIFFLLCLAGRALASTIEEQAKTFLDKENHEAEDLFYQSSLASWNYNTNITEENVQNMNNAGDKWSAFL
KEQSTLAQMYPLQEIQNLTVKLQLQALQQNGSSVLSEDKSKRLNTILNTMSTIYSTGKVCNPDNPQECLLLEP
GLNEIMANSLDYNERLWAWESWRSEVGKQLRPLYEEYVVLKNEMARANHYEDYGDYWRGDYEVNGVDGYDYSR
GQLIEDVEHTFEEIKPLYEHLHAYVRAKLMNAYPSYISPIGCLPAHLLGDMWGREWTNLYSLTVPFGQKPNID
VTDAMVDQAWDAQRIFKEAEKFFVSVGLPNMTQGFWENSMLTDPGNVQKAVCHPTAWDLGKGDERILMCTKVT
MDDFLTAHHEMGHIQYDMAYAAQPFLLRNGANEGFHEAVGEIMSLSAATPKHLKSIGLLSPDFQEDNETEINF
LLKQALTIVGTLPFTYMLEKWRWMVFKGEIPKDQWMKKWWEMKREIVGVVEPVPHDETYCDPASLFHVSNDYS
FIRYYTGTLYQFQFQEALCQAAKHEGPLHKCDISNSTEAGQKLENMLRLGKSEPWTLALENVVGAKNMNVRPL
LNYFEPLFTWLKDQNKNSFVGWSTDWSPYADPLVPRGSGGGGDPEPKSCDKTHTCPPCPAPELLGGPSVFLFP
PKPKDTLMISRTPEVTCVVVDVSHEDPEVKENWYVDGVEVHNAKTKPREEQYNSTYRVVSVLTVLHQDWLNGK
EYKCKVSNKALPAPIEKTISKAKGQPREPQVYTLPPSRDELTKNQVSLTCLVKGFYPSDIAVEWESNGQPENN
YKTTPPVLDSDGSFFLYSKLTVDKSRWQQGNVFSCSVMHEALHNHYTQKSLSLSPGK (SEQ ID NO: 162)

>mACE2-Fc
MPMGSLQPLATLYLLGMLVASVLAQSTIEEQAKTFLDKENHEAEDLFYQSSLASWNYNTNITEENVQNMNNAG
EKWSAFLKEQSTLAQMYPLQEIQNLTVKLQLQALQQNGSSVLSEDKSKRLNTILNTMSTIYSTGKVCNPNNPQ
ECLLLDPGLNEIMEKSLDYNERLWAWEGWRSEVGKQLRPLYEEYVVLKNEMARANHYKDYGDYWRGNYEVNGV
DGYDYNRDQLIEDVERTFEEIKPLYEHLHAYVRAKLMNAYPSYISPTGCLPAHLLGDMWGREWTNLYSLTVPF
GQKPNIDVTDAMVNQAWNAQRIFKEAEKFFVSVGLPNMTQGFWENSMLTDPGNVQKVVCHPTAWDLGKGDERI
IMCTKVTMDDFLTAHHEMGHIQYDMAYAAQPFLLRNGANEGFHEAVGEIMSLSAATPKHLKSIGLLSPDFQED
NETEINFLLKQALTIVGTLPFTYMLEKWRWMVFKGEIPKDQWMKKWWEMKREIVGVVEPVPHDETYCDPASLE
HVSNDYSFIRYYTRTLYQFQFQEALCQAAKHEGPLHKCDISNSTEAGQKLLNMLKLGKSEPWTLALENVVGAK
NMNVRPLLNYFEPLFTWLKDQNKNSFVGWSTDWSPYADQSIKVRISLKSALGDKAYEWNDNEMYLERSSVAYA
MRTYFLEIKHQTILFGEEDVRVADLKPRISENFYVTAPKNVSDIIPRTEVEEAIRISRSRINDAFRLNDNSLE
FLGIQTTLAPPYQSPVTDPLVPRGSGGGGDPEPKSCDKTHTCPPCPAPELLGGPSVFLFPPKPKDTLMISRTP
EVTCVVVDVSHEDPEVKENWYVDGVEVHNAKTKPREEQYNSTYRVVSVLTVLHQDWLNGKEYKCKVSNKALPA
PIEKTISKAKGQPREPQVYTLPPSRDELTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 163)

>RBD-8GS-I53-50A
MGILPSPGMPALLSLVSLLSVLLMGCVAETGTREPNITNLCPFGEVENATRFASVYAWNRKRISNCVADYSVL
YNSASFSTFKCYGVSPTKLNDLCFTNVYADSFVIRGDEVRQIAPGQTGKIADYNYKLPDDETGCVIAWNSNNL
DSKVGGNYNYLYRLFRKSNLKPFERDISTEIYQAGSTPCNGVEGENCYFPLQSYGFQPTNGVGYQPYRVVVLS
FELLHAPATVCGPKKSTGGSGGSGSEKAAKAEEAARKMEELFKKHKIVAVLRANSVEEAIEKAVAVFAGGVHL
IEITFTVPDADTVIKALSVLKEKGAIIGAGTVTSVEQARKAVESGAEFIVSPHLDEEISQFAKEKGVFYMPGV
MTPTELVKAMKLGHTILKLFPGEVVGPQFVKAMKGPFPNVKFVPTGGVNLDNVAEWFKAGVLAVGVGSALVKG
TPDEVREKAKAFVEKIRGATEGGSHHHHHHHH (SEQ ID NO: 14)

>RBD-12GS-I53-50A
MGILPSPGMPALLSLVSLLSVLLMGCVAETGTREPNITNLCPFGEVENATRFASVYAWNRKRISNCVADYSVL
YNSASFSTFKCYGVSPTKLNDLCFTNVYADSFVIRGDEVRQIAPGQTGKIADYNYKLPDDFTGCVIAWNSNNL
DSKVGGNYNYLYRLFRKSNLKPFERDISTEIYQAGSTPCNGVEGENCYFPLQSYGFQPTNGVGYQPYRVVVLS
FELLHAPATVCGPKKSTGSGSGGSGGSGSEKAAKAEEAARKMEELFKKHKIVAVLRANSVEEAIEKAVAVFAG
GVHLIEITFTVPDADTVIKALSVLKEKGAIIGAGTVTSVEQARKAVESGAEFIVSPHLDEEISQFAKEKGVFY
MPGVMTPTELVKAMKLGHTILKLFPGEVVGPQFVKAMKGPFPNVKFVPTGGVNLDNVAEWFKAGVLAVGVGSA
LVKGTPDEVREKAKAFVEKIRGATEGGSHHHHHHHH (SEQ ID NO: 22)

>RBD-16GS-I53-50A
MGILPSPGMPALLSLVSLLSVLLMGCVAETGTRFPNITNLCPFGEVENATRFASVYAWNRKRISNCVADYSVL
YNSASFSTFKCYGVSPTKLNDLCFTNVYADSFVIRGDEVRQIAPGQTGKIADYNYKLPDDETGCVIAWNSNNL
DSKVGGNYNYLYRLFRKSNLKPFERDISTEIYQAGSTPCNGVEGENCYFPLQSYGFQPTNGVGYQPYRVVVLS
FELLHAPATVCGPKKSTGGSGGSGSGGSGGSGSEKAAKAEEAARKMEELFKKHKIVAVLRANSVEEAIEKAVA
VFAGGVHLIEITFTVPDADTVIKALSVLKEKGAIIGAGTVTSVEQARKAVESGAEFIVSPHLDEEISQFAKEK
GVFYMPGVMTPTELVKAMKLGHTILKLFPGEVVGPQFVKAMKGPFPNVKFVPTGGVNLDNVAEWFKAGVLAVG
VGSALVKGTPDEVREKAKAFVEKIRGATEGGSHHHHHHHH (SEQ ID NO: 2)

>Monomeric SARS-CoV-2 RBD
MGILPSPGMPALLSLVSLLSVLLMGCVAETGTRFPNITNLCPFGEVENATRFASVYAWNRKRISNCVADYSVL
YNSASFSTFKCYGVSPTKLNDLCFTNVYADSFVIRGDEVRQIAPGQTGKIADYNYKLPDDFTGCVIAWNSNNL
DSKVGGNYNYLYRLFRKSNLKPFERDISTEIYQAGSTPCNGVEGENCYFPLQSYGFQPTNGVGYQPYRVVVLS
FELLHAPATVCGPKKSTHHHHHHHH (SEQ ID NO: 160)

>SARS-CoV-2 S-2P Trimer
MGILPSPGMPALLSLVSLLSVLLMGCVAETGTQCVNLTTRTQLPPAYTNSFTRGVYYPDKVERSSVLHSTQDL
FLPFFSNVTWFHAIHVSGTNGTKRFDNPVLPENDGVYFASTEKSNIIRGWIFGTTLDSKTQSLLIVNNATNVV TABLE 3-continued

| Amino acid sequences of proteins used in this work (See FIGS. 1-6) |
|---|
| IKVCEFQFCNDPFLGVYYHKNNKSWMESEFRVYSSANNCTFEYVSQPFLMDLEGKQGNEKNLREFVFKNIDGY |
| FKIYSKHTPINLVRDLPQGFSALEPLVDLPIGINITRFQTLLALHRSYLTPGDSSSGWTAGAAAYYVGYLQPR |
| TFLLKYNENGTITDAVDCALDPLSETKCTLKSFTVEKGIYQTSNERVQPTESIVRFPNITNLCPFGEVENATR |
| FASVYAWNRKRISNCVADYSVLYNSASFSTFKCYGVSPTKLNDLCFTNVYADSFVIRGDEVRQIAPGQTGKIA |
| DYNYKLPDDFTGCVIAWNSNNLDSKVGGNYNYLYRLERKSNLKPFERDISTEIYQAGSTPCNGVEGENCYFPL |
| QSYGFQPTNGVGYQPYRVVVLSFELLHAPATVCGPKKSTNLVKNKCVNENENGLTGTGVLTESNKKELPFQQF |
| GRDIADTTDAVRDPQTLEILDITPCSFGGVSVITPGTNTSNQVAVLYQDVNCTEVPVAIHADQLTPTWRVYST |
| GSNVFQTRAGCLIGAEHVNNSYECDIPIGAGICASYQTQTNSPSGAGSVASQSIIAYTMSLGAENSVAYSNNS |
| IAIPTNFTISVTTEILPVSMTKTSVDCTMYICGDSTECSNLLLQYGSFCTQLNRALTGIAVEQDKNTQEVFAQ |
| VKQIYKTPPIKDFGGFNFSQILPDPSKPSKRSFIEDLLENKVTLADAGFIKQYGDCLGDIAARDLICAQKENG |
| LTVLPPLLTDEMIAQYTSALLAGTITSGWTFGAGAALQIPFAMQMAYRENGIGVTQNVLYENQKLIANQFNSA |
| IGKIQDSLSSTASALGKLQDVVNQNAQALNTLVKQLSSNFGAISSVLNDILSRLDPPEAEVQIDRLITGRLQS |
| LQTYVTQQLIRAAEIRASANLAATKMSECVLGQSKRVDFCGKGYHLMSFPQSAPHGVVFLHVTYVPAQEKNFT |
| TAPAICHDGKAHFPREGVFVSNGTHWFVTQRNFYEPQIITTDNTFVSGNCDVVIGIVNNTVYDPLQPELDSEK |
| EELDKYFKNHTSPDVDLGDISGINASVVNIQKEIDRLNEVAKNLNESLIDLQELGKYEQYIKGSGRENLYFQG |
| GGGSGYIPEAPRDGQAYVRKDGEWVLLSTELGHHHHHHHH (SEQ ID NO: 161) |
| |
| >hACE2 (R518G)-Fc |
| MARAWIFFLLCLAGRALASTIEEQAKTFLDKENHEAEDLFYQSSLASWNYNTNITEENVQNMNNAGDKWSAFL |
| KEQSTLAQMYPLQEIQNLTVKLQLQALQQNGSSVLSEDKSKRLNTILNTMSTIYSTGKVCNPDNPQECLLLEP |
| GLNEIMANSLDYNERLWAWESWRSEVGKQLRPLYEEYVVLKNEMARANHYEDYGDYWRGDYEVNGVDGYDYSR |
| GQLIEDVEHTFEEIKPLYEHLHAYVRAKLMNAYPSYISPIGCLPAHLLGDMWGREWTNLYSLTVPFGQKPNID |
| VTDAMVDQAWDAQRIFKEAEKFFVSVGLPNMTQGFWENSMLTDPGNVQKAVCHPTAWDLGKGDERILMCTKVT |
| MDDELTAHHEMGHIQYDMAYAAQPFLLRNGANEGFHEAVGEIMSLSAATPKHLKSIGLLSPDFQEDNETEINE |
| LLKQALTIVGTLPFTYMLEKWRWMVFKGEIPKDQWMKKWWEMKREIVGVVEPVPHDETYCDPASLFHVSNDYS |
| FIRYYTGTLYQFQFQEALCQAAKHEGPLHKCDISNSTEAGQKLENMLRLGKSEPWTLALENVVGAKNMNVRPL |
| LNYFEPLFTWLKDQNKNSFVGWSTDWSPYADPLVPRGSGGGGDPEPKSCDKTHTCPPCPAPELLGGPSVELEP |
| PKPKDTLMISRTPEVTCVVVDVSHEDPEVKENWYVDGVEVHNAKTKPREEQYNSTYRVVSVLTVLHQDWLNGK |
| EYKCKVSNKALPAPIEKTISKAKGQPREPQVYTLPPSRDELTKNQVSLTCLVKGFYPSDIAVEWESNGQPENN |
| YKTTPPVLDSDGSFFLYSKLTVDKSRWQQGNVFSCSVMHEALHNHYTQKSLSLSPGK (SEQ ID NO: 162) |
| |
| >mACE2-Fc |
| MPMGSLQPLATLYLLGMLVASVLAQSTIEEQAKTELDKENHEAEDLFYQSSLASWNYNTNITEENVQNMNNAG |
| EKWSAFLKEQSTLAQMYPLQEIQNLTVKLQLQALQQNGSSVLSEDKSKRLNTILNTMSTIYSTGKVCNPNNPQ |
| ECLLLDPGLNEIMEKSLDYNERLWAWEGWRSEVGKQLRPLYEEYVVLKNEMARANHYKDYGDYWRGNYEVNGV |
| DGYDYNRDQLIEDVERTFEEIKPLYEHLHAYVRAKLMNAYPSYISPTGCLPAHLLGDMWGREWTNLYSLTVPF |
| GQKPNIDVTDAMVNQAWNAQRIFKEAEKFFVSVGLPNMTQGFWENSMLTDPGNVQKVVCHPTAWDLGKGDERI |
| IMCTKVTMDDFLTAHHEMGHIQYDMAYAAQPFLLRNGANEGFHEAVGEIMSLSAATPKHLKSIGLLSPDFQED |
| NETEINFLLKQALTIVGTLPFTYMLEKWRWMVFKGEIPKDQWMKKWWEMKREIVGVVEPVPHDETYCDPASLE |
| HVSNDYSFIRYYTRTLYQFQFQEALCQAAKHEGPLHKCDISNSTEAGQKLLNMLKLGKSEPWTLALENVVGAK |
| NMNVRPLLNYFEPLFTWLKDQNKNSFVGWSTDWSPYADQSIKVRISLKSALGDKAYEWNDNEMYLERSSVAYA |
| MRTYFLEIKHQTILFGEEDVRVADLKPRISENFYVTAPKNVSDIIPRTEVEEAIRISRSRINDAFRLNDNSLE |
| FLGIQTTLAPPYQSPVTDPLVPRGSGGGGDPEPKSCDKTHTCPPCPAPELLGGPSVFLFPPKPKDTLMISRTP |
| EVTCVVVDVSHEDPEVKENWYVDGVEVHNAKTKPREEQYNSTYRVVSVLTVLHQDWLNGKEYKCKVSNKALPA |
| PIEKTISKAKGQPREPQVYTLPPSRDELTKNQVSLTCLVKGFYPSDIAVEWESNGQPENNYKTTPPVLDSDGS |
| FFLYSKLTVDKSRWQQGNVFSCSVMHEALHNHYTQKSLSLSPGK (SEQ ID NO: 163) |

Figure 7:
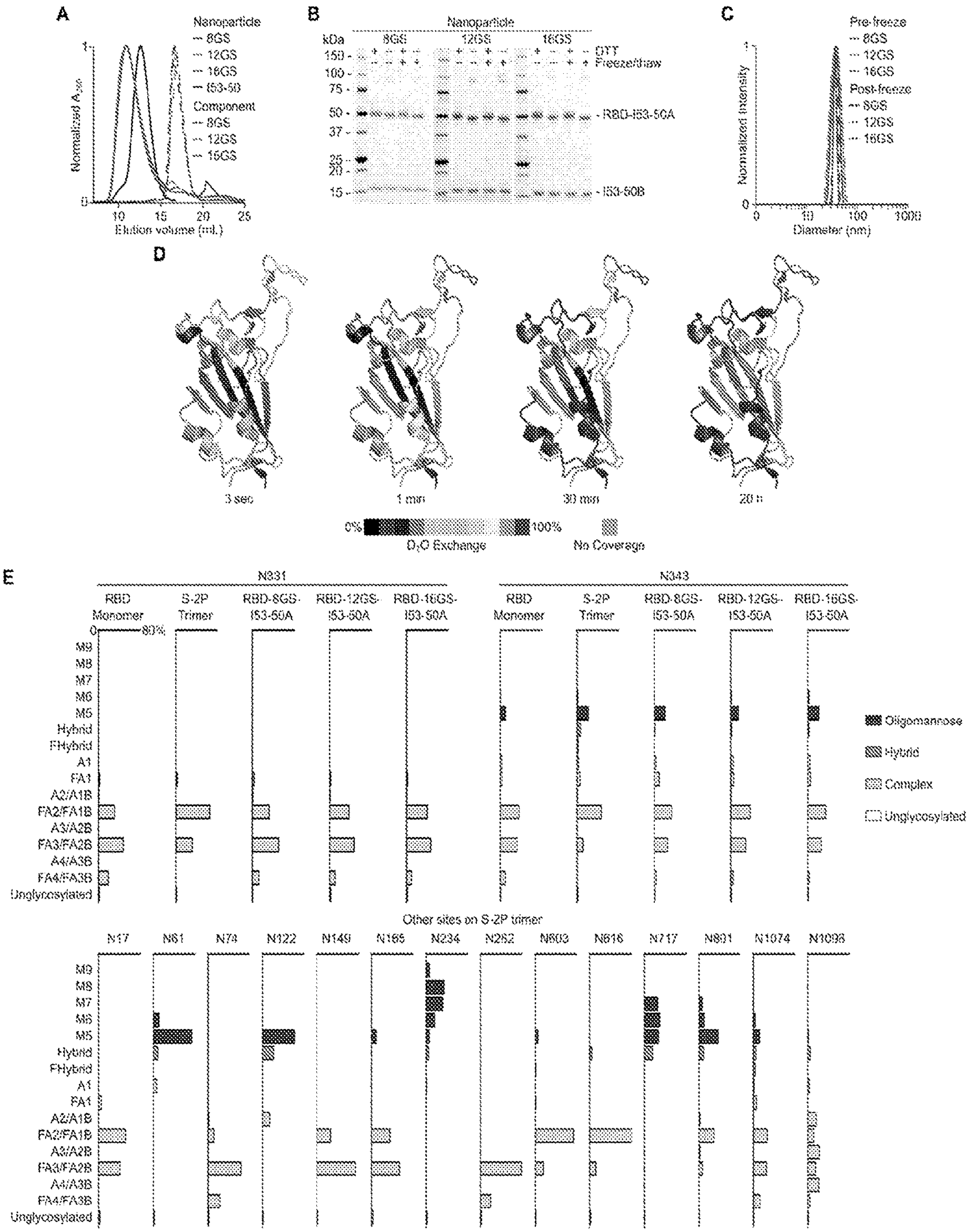
FIG. 7 (A-E). Additional characterization of RBD Nanoparticle Immunogens. (A) Size exclusion chromatography of RBD-I53-50 nanoparticles, unmodified I53-50 nanoparticle, and trimeric RBD-I53-50A components on a Superose™ 6 Increase 10/300 GL. (B) SDS-PAGE of SEC-purified RBD-I53-50 nanoparticles under reducing and non-reducing conditions before and after one freeze/thaw cycle. (C) Dynamic light scattering of RBD-I53-50 nanoparticles before and after one freeze/thaw cycle indicates monodisperse nanoparticles with a lack of detectable aggregates in each sample. (D) Hydrogen/Deuterium-exchange mass spectrometry, represented here as heatmaps, reveals the structural accessibility and dynamics on RBD (PDB 6W41). Color codes indicate deuterium uptake levels. Monomeric RBD and RBD-8GS-I53-50A have indistinguishable uptake patterns, and are presented in a single heatmap at each time point. (E) Top, bar graphs reveal similar glycan profiles at the N-linked glycosylation sites N331 and N343 in five protein samples: monomeric RBD, S-2P trimer, and RBD-8GS-, RBD-12GS-, and RBD-16GS-I53-50A trimeric components. Bottom, comprehensive glycan profiling on other N-linked glycosylation sites besides N331 and N343 that are found in the S-2P trimer. The axis of each bar graph is scaled to 0-80%. M9 to M5, oligomannose with 9 to 5 mannose residues, are colored dark gray. Hybrid and FHybrid, hybrid types with or without fucosylation are gray. Subtypes in complex type, shown in light gray, are classified based on antennae number and fucosylation.

Size-exclusion chromatography (SEC) of the SARS-COV-2 RBD-I53-50 nanoparticles revealed predominant peaks corresponding to the target icosahedral assemblies and smaller peaks comprising residual unassembled RBD-I53-50A components (FIGS. 7A and 7B). Dynamic light scattering (DLS) and negative stain electron microscopy (nsEM) confirmed the homogeneity and monodispersity of the various RBD-I53-50 nanoparticles, both before and after freeze/thaw (FIGS. 1E, 1F, and 7C). The average hydrodynamic diameter and percent polydispersity measured by DLS for RBD-8GS-, RBD-12GS-, and RBD-16GS-I53-50 before freeze/thaw were 38.5 (27%), 37 (21%), and 41 (27%) nm, respectively, compared to 30 (22%) nm for unmodified I53-50 nanoparticles. Hydrogen/Deuterium-exchange mass spectrometry confirmed that display of the RBD on the trimeric RBD-8GS-I53-50A component preserved the conformation of the antigen and structural order of several distinct antibody epitopes (FIGS. 1G and 7D). Finally, we used glycoproteomics to show that all three RBD-I53-50A components were N-glycosylated at positions N331 and N343 similarly to the SARS-COV-2 S-2P ectodomain trimer (Watanabe et al., 2020), again suggesting that the displayed antigen retained its native antigenic properties (FIGS. 1H and 7E).

TABLE 4

Antigenic Characterization of SARS-CoV-2 RBD-I53-50A Components

| Antigen | Binder | $k_{on}$ ($M^{-1}$ $s^{-1}$) | $k_{off}$ ($s^{-1}$) | $K_D$ (nM) |
|---|---|---|---|---|
| SARS-CoV-2 RBD | hACE2 | $7 \times 10^4 \pm 5 \times 10^2$ | $5 \times 10^{-3} \pm 1 \times 10^{-5}$ | 69 ± 0.5 |
| | CR3022 Fab | $2 \times 10^5 \pm 2 \times 10^3$ | $9 \times 10^{-3} \pm 3 \times 10^{-5}$ | 45 ± 0.5 |
| RBD-8GS-I53-50A | hACE2 | $6 \times 10^4 \pm 4 \times 10^2$ | $4 \times 10^{-3} \pm 1 \times 10^{-5}$ | 70 ± 0.5 |
| | CR3022 Fab | $2 \times 10^5 \pm 1 \times 10^3$ | $1 \times 10^{-2} \pm 3 \times 10^{-5}$ | 57 ± 0.4 |

TABLE 4-continued

| Antigenic Characterization of SARS-CoV-2 RBD-I53-50A Components | | | | |
|---|---|---|---|---|
| Antigen | Binder | $k_{on}$ ($M^{-1}$ $s^{-1}$) | $k_{off}$ ($s^{-1}$) | $K_D$ (nM) |
| RBD-12GS-I53-50A | hACE2 | $6 \times 10^4 \pm 4 \times 10^2$ | $5 \times 10^{-3} \pm 1 \times 10^{-5}$ | 78 ± 0.5 |
| | CR3022 Fab | $2 \times 10^5 \pm 2 \times 10^3$ | $9 \times 10^{-3} \pm 2 \times 10^{-5}$ | 42 ± 0.4 |
| RBD-16GS-I53-50A | hACE2 | $6 \times 10^4 \pm 4 \times 10^2$ | $4 \times 10^{-2} \pm 1 \times 10^{-5}$ | 66 ± 0.4 |
| | CR3022 Fab | $2 \times 10^5 \pm 1 \times 10^3$ | $1 \times 10^{-2} \pm 2 \times 10^{-5}$ | 56 ± 0.4 |

Each experiment was performed at least twice, and the values and fitting errors presented are derived from a representative experiment. The corresponding binding curves and fits are presented in FIG. 8.

Antigenic Characterization of SARS-COV-2 RBD-I53-50 Nanoparticle Components and Immunogens We used recombinant human ACE2 ectodomain and two S-specific mAbs (CR3022 and S309) to characterize the antigenicity of the RBD when fused to I53-50A as well as the accessibility of multiple RBD epitopes in the context of the assembled nanoparticle immunogens. CR3022 and S309 were both isolated from individuals infected with SARS-CoV and cross-react with the SARS-COV-2 RBD. CR3022 is a weakly neutralizing Ab that binds to a conserved, cryptic epitope in the RBD that becomes accessible upon RBD opening but is distinct from the receptor binding motif (RBM), the surface of the RBD that interacts with ACE2 (Huo et al., 2020; ter Meulen et al., 2006; Yuan et al., 2020). S309 neutralizes both SARS COV and SARS-COV-2 by binding to a glycan-containing epitope that is conserved amongst sarbecoviruses and accessible in both the open and closed prefusion S conformational states (Pinto et al., 2020).

We used bio-layer interferometry (BLI) to confirm the binding affinities of the monomeric human ACE2 (hACE2) ectodomain and the CR3022 Fab for the monomeric RBD. Equilibrium dissociation constants ($K_D$) of these reagents for immobilized RBD-I53-50A fusion proteins closely matched those obtained for the monomeric RBD (Table 4 and FIG. 8). These data further confirm that the RBD-I53-50A fusion proteins display the RBD in its native conformation.

Figure 9:
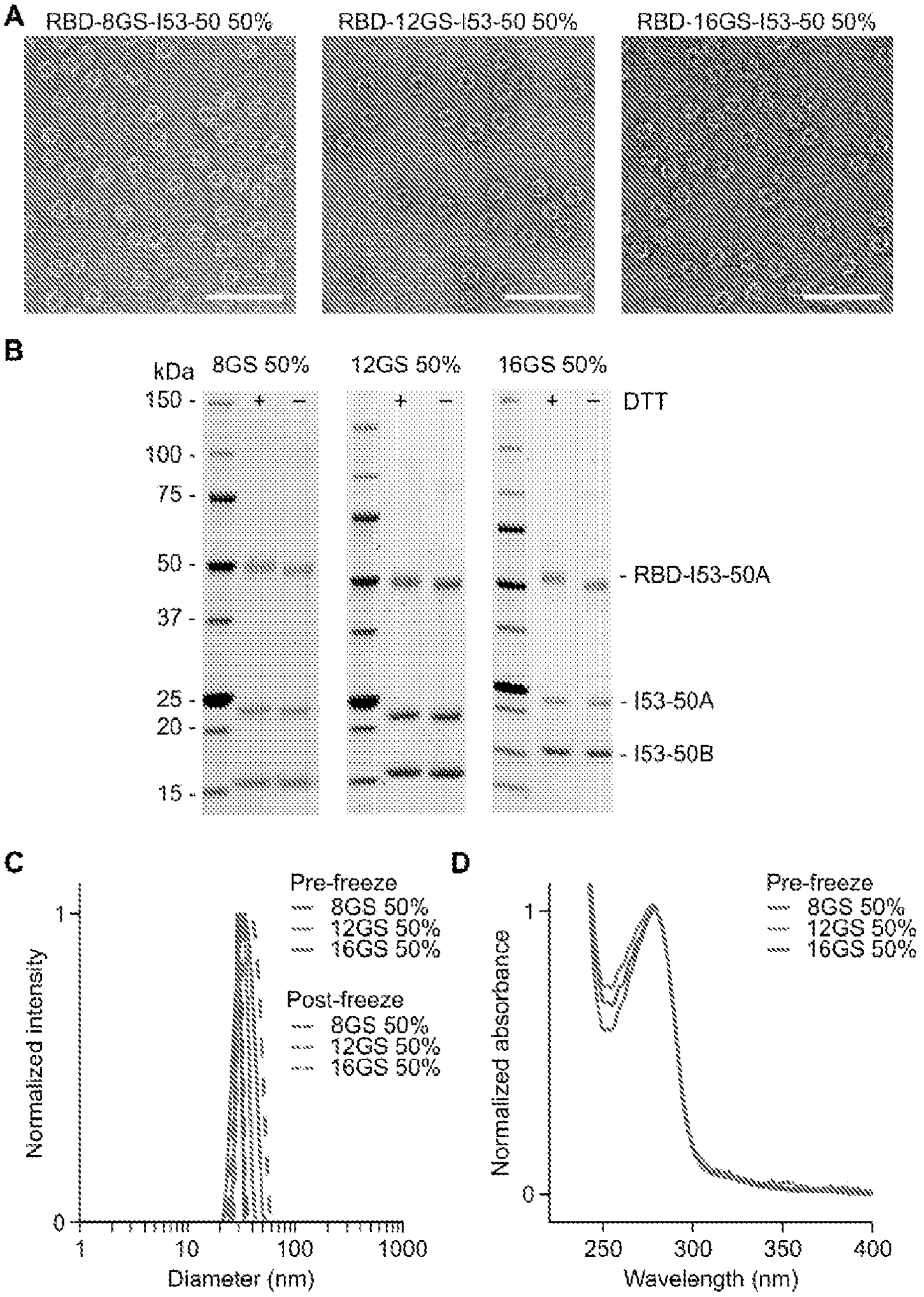
FIG. 9 (A-D). Characterization of Partial Valency RBD Nanoparticles (A) Representative electron micrographs of negatively stained RBD-8GS-, RBD-12GS-, and RBD-16GS-I53-50 nanoparticles displaying the RBD at 50% valency. The samples were imaged after one freeze/thaw cycle. Scale bars, 100 nm. (B) SDS-PAGE of purified RBD-8GS-, RBD-12GS-, and RBD-16GS-I53-50 nanoparticles displaying the RBD at 50% valency. Both RBD-bearing and unmodified I53-50A subunits are visible on the gels. (C) Dynamic light scattering (DLS) of 50% valency RBD-8GS-, RBD-12GS-, and RBD-16GS-153-50 nanoparticles both before and after freeze/thaw. No aggregates or unassembled components were observed. (D) UV/vis absorption spectra of 50% valency RBD-8GS-, RBD-12GS-, and RBD-16GS-I53-50 nanoparticles. Turbidity in the samples is low, as indicated by the low absorbance at 320 nm.

To evaluate the possibility that the magnitude and quality of nanoparticle immunogen-elicited Ab responses can be modulated by the accessibility of specific epitopes in the context of a dense, multivalent antigen array, we measured the binding of the nanoparticle immunogens to immobilized dimeric macaque ACE2 (mACE2-Fc) and the CR3022 and S309 mAbs, the latter of which roughly mimics the B cell receptor (BCR)-antigen interaction that is central to B cell activation. This approach does not allow the calculation of $K_D$ values due to the multivalent nature of the interactions, but does enable qualitative comparisons of epitope accessibility in different nanoparticle constructs. We compared the full-valency nanoparticles displaying 60 RBDs to a less dense antigen array by leveraging the versatility of in vitro assembly to prepare nanoparticle immunogens displaying the RBD antigen at 50% valency (~30 RBDs per nanoparticle) (FIG. 9). This was achieved by adding pentameric I53-50B to an equimolar mixture of RBD-I53-50A and unmodified 153-50A lacking fused antigen. We found that all of the RBD nanoparticles bound well to the immobilized mACE2-Fc, CR3022, and S309 (FIG. 2A). Although there were no consistent trends among the 50% and 100% valency RBD-8GS- and RBD-12GS-I53-50 nanoparticles, the 100% valency RBD-16GS-I53-50 nanoparticles resulted in the highest binding signals against all three binders (FIG. 2B). It is possible that the longer linker in the RBD-16GS-153-50 nanoparticle enables better access to the epitopes targeted by ACE2, CR3022, and S309, although our data cannot rule out other possible explanations. We conclude that multiple distinct epitopes targeted by neutralizing antibodies are exposed and accessible for binding in the context of the RBD antigen array presented on the nanoparticle exterior.

Physical and Antigenic Stability of RBD Nanoparticle Immunogens and S-2P Trimer

Figure 10:
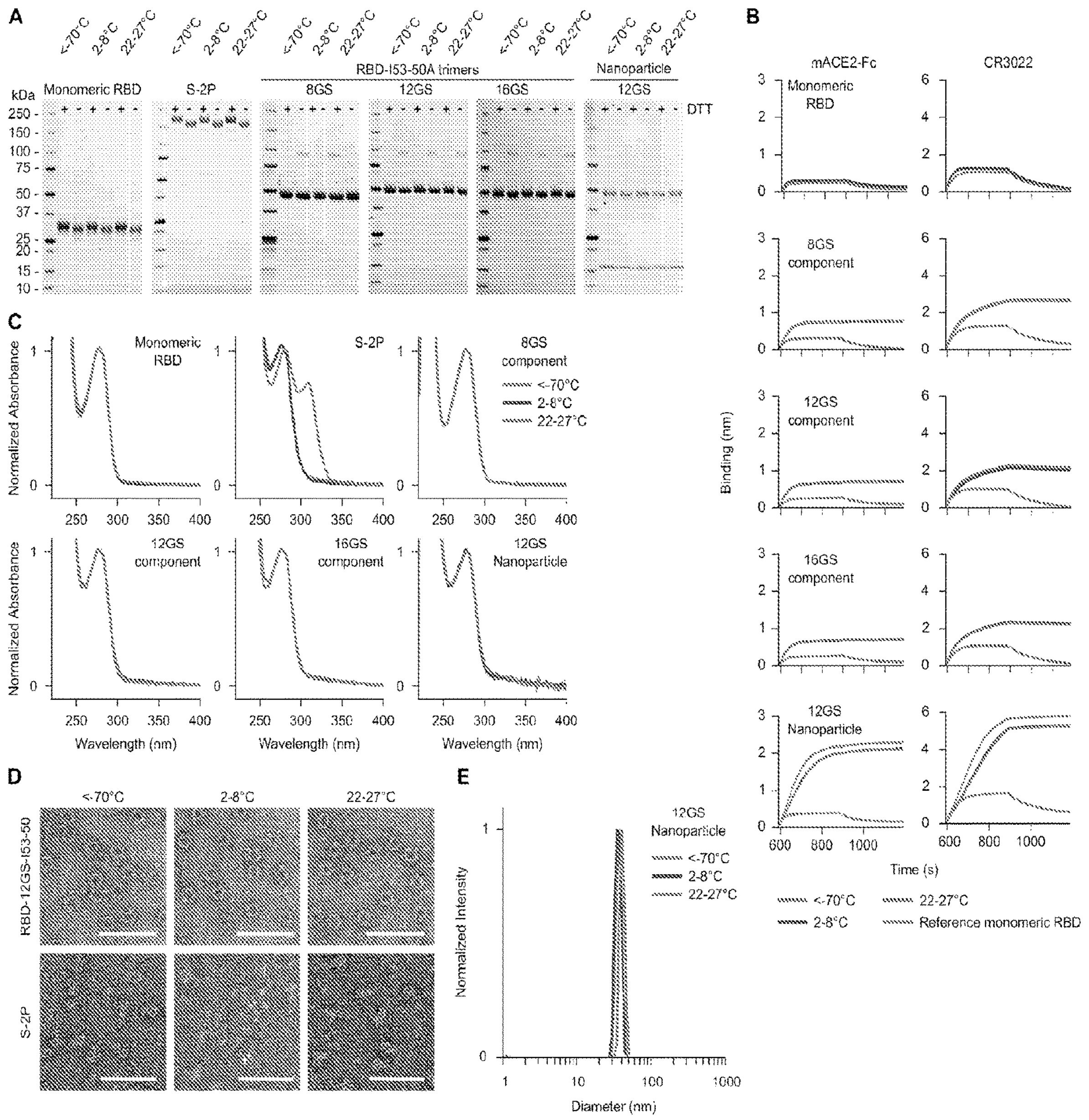
FIG. 10 (A-E). Day 28 Stability Data. (A) SDS-PAGE of purified monomeric RBD, S-2P trimer, RBD-I53-50A components and RBD-12GS-I53-50 nanoparticle in reducing and non-reducing conditions. No degradation of any immunogen was observed after a four-week incubation at any temperature analyzed. (B) Analysis of mACE2-Fc and CR3022 IgG binding to monomeric RBD, RBD-I53-50A trimeric components, and RBD-12GS-I53-50 nanoparticle by BLI after a four-week incubation at three temperatures. Monomeric RBD was used as a reference standard in nanoparticle component and nanoparticle BLI experiments. The RBD-12GS-I53-50 nanoparticle lost minimal binding at the higher temperatures after four weeks; the remaining antigens did not lose any mACE2-Fc or CR3022 IgG binding over the course of the study. (C) UV/vis spectroscopy showed minimal absorbance in the near-UV, suggesting a lack of aggregation/particulates after a four week-incubation at three temperatures, with the exception of S-2P trimer, which gained significant absorbance around 320 nm at ambient temperature. RBD-12GS-I53-50 nanoparticle samples at 22-27° C. at several earlier time points exhibited similar peaks near 320 nm (see Supplementary Item 2). (D) nsEM of RBD-12GS-I53-50 nanoparticle (top) and S-2P trimer (bottom) after a four-week incubation at three temperatures. Intact monodisperse nanoparticles were observed at all temperatures, with no observed degradation or aggregation. The S-2P trimer remained well folded in the <−70 and 22-27° C. samples, but was unfolded in samples incubated at 2-8° C. Scale bars: RBD-12GS-I53-50, 100 nm; S-2P, 50 nm. (E) DLS of the RBD-12GS-I53-50 nanoparticle after a four-week incubation at three temperatures. No aggregation was observed at any temperature.

We first used chemical denaturation in guanidine hydrochloride (GdnHCl) to compare the stability of the RBD-I53-50A fusion proteins and RBD-12GS-I53-50 nanoparticle immunogen to recombinant monomeric RBD and the S-2P ectodomain trimer (FIG. 3A). Fluorescence emission spectra from samples incubated in 0-6.5 M GdnHCl revealed that all three RBD-I53-50A fusion proteins and the RBD-12GS-I53-50 nanoparticle undergo a transition between 4 and 5 M GdnHCl that indicates at least partial unfolding, whereas the S-2P trimer showed a transition at lower [GdnHCl], between 2 and 4 M. The monomeric RBD exhibited a less cooperative unfolding transition over 0-5 M GdnHCl. We then used a suite of analytical assays to monitor physical and antigenic stability over four weeks post-purification at three temperatures: <–70° C., 2-8° C., and 22-27° C. (FIG. 3B-E). Consistent with previous reports, the monomeric RBD proved quite stable, yielding little change in appearance by SDS-PAGE (FIG. 10A), mACE2-Fc and CR3022 binding (FIG. 10B), or the ratio of UV/vis absorption at 320/280 nm, a measure of particulate scattering (FIG. 10C). The S-2P trimer was unstable at 2-8° C., exhibiting clear signs of unfolding by nsEM even at early time points (FIG. 9D). It maintained its structure considerably better at 22-27° C. until the latest time point (28 days), when unfolding was apparent by nsEM and UV/vis indicated some aggregation (FIG. 10C). All three RBD-I53-50A components were highly stable, exhibiting no substantial change in any readout at any time point (data not shown). Finally, the RBD-12GS-I53-50 nanoparticle was also quite stable over the four-week study, showing changes only in UV/vis absorbance, where a peak near 320 nm appeared after 7 days at 22-27° C. (data not shown). Electron micrographs and DLS of the RBD-12GS-I53-50 nanoparticle samples consistently showed monodisperse, well-formed nanoparticles at all temperatures over the four-week period (FIGS. 10D, 10E). Collectively, these data show that the RBD-I53-50A components and the RBD-12GS-I53-50 nanoparticle have high physical and antigenic stability, superior to the S-2P ectodomain trimer.

RBD-I53-50 Nanoparticle Immunogens Elicit Potent Neutralizing Antibody Responses in BALB/c and Human Immune Repertoire Mice.

Figure 11:
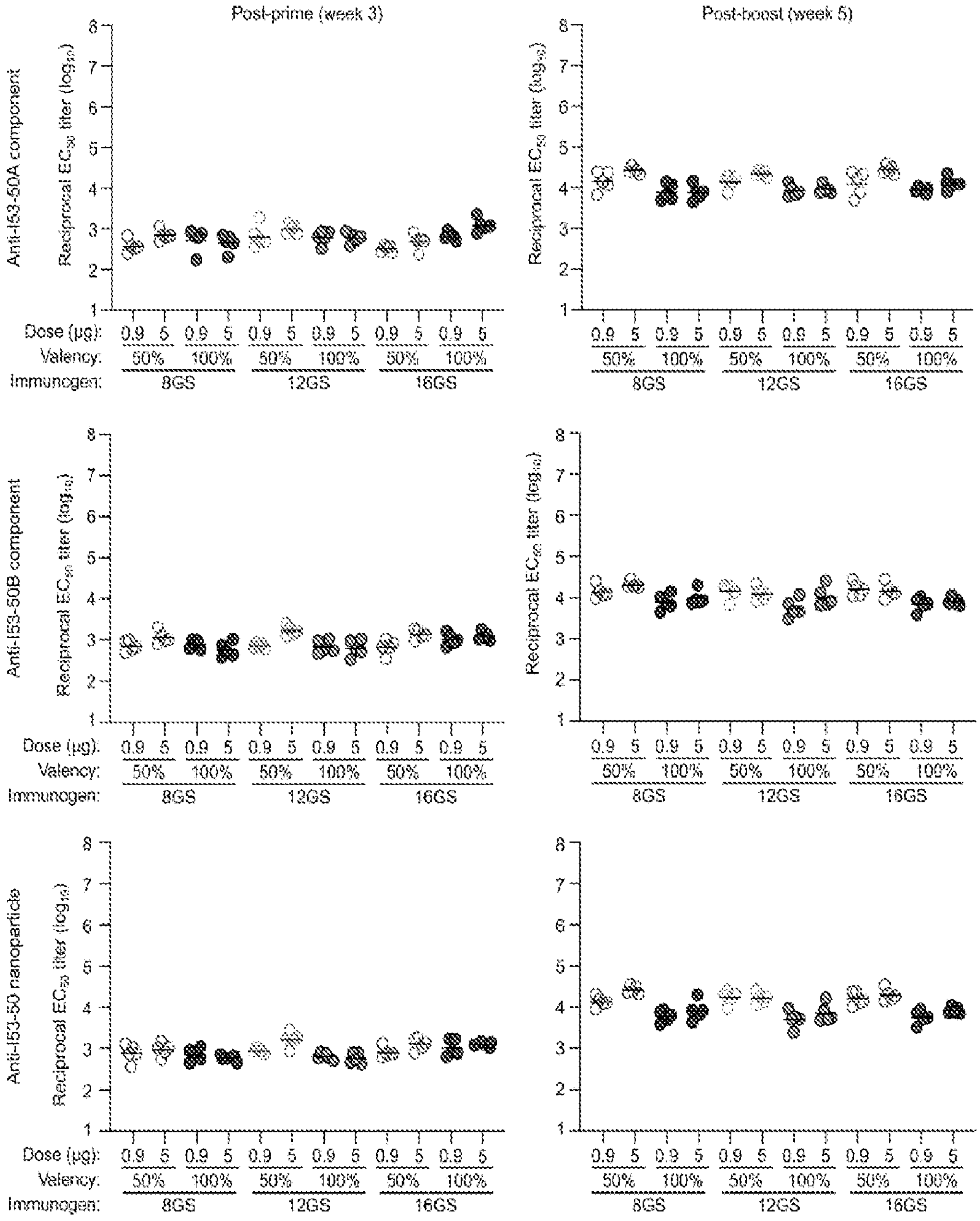
FIG. 11. Subclasses of vaccine-elicited Abs and anti-scaffold antibody titers. Levels of vaccine-elicited IgG specific to the (top) trimeric I53-50A component, (middle) pentameric I53-50B component, and (bottom) assembled I53-50 nanoparticle two weeks post-prime (left) and post-boost (right) in BALB/c mice.

We compared the immunogenicity of the three RBD-I53-50 nanoparticles, each displaying the RBD at either 50% or 100% valency, to the S-2P ectodomain trimer and the monomeric RBD in BALB/c mice. Groups of ten mice were immunized intramuscularly at weeks 0 and 3 with AddaVax™-adjuvanted formulations containing either 0.9 or 5 μg of SARS-COV-2 antigen in either soluble or particulate form. Three weeks post-prime, all RBD nanoparticles elicited robust S-specific Ab responses with geometric mean reciprocal half-maximal effective concentrations ranging between $8\times10^2$ and $1\times10^4$ (FIG. 4A). In contrast, the monomeric RBD and the low dose of S-2P trimer did not induce detectable levels of S-specific Abs, while the high dose of S-2P trimer elicited weak responses. Following a second immunization, we observed an enhancement of S-specific Ab titers for all RBD nanoparticle groups, with geometric mean titers (GMT) ranging from $1\times10^5$ to $2\times10^6$ (FIG. 4B). These levels of S-specific Abs matched or exceeded most samples from a panel of 29 COVID-19 human convalescent sera (HCS) from Washington state and the benchmark 20/130 COVID-19 plasma from NIBSC (FIG. 4A-B, Table 5). Immunization with two 5 μg doses of S-2P trimer induced S-specific Ab responses ~1-2 orders of magnitude weaker than the RBD nanoparticles, and the monomeric RBD did not elicit detectable antigen-specific Abs after two immunizations. As expected, we also detected an Ab response to the I53-50 scaffold, which was constant in magnitude across all RBD nanoparticle groups (FIG. 11). These data indicate that multivalent display of the RBD on a self-assembling nanoparticle scaffold dramatically improves its immunogenicity.

TABLE 5

| | Source of patient convalescent sera | | |
|---|---|---|---|
| | Hospitalized (N = 4) | Not Hospitalized (N = 22) | Overall (N = 26) |
| Age | | | |
| Mean (SD) | 58.0 (15.1) | 45.1 (17.2) | 47.1 (17.2) |
| Median [Min, Max] | 64.8 [35.5, 67.0] | 43.6 [18.1, 76.0] | 45.4 [18.1, 76.0] |
| Sex | | | |
| Male | 1 (25.0%) | 11 (50.0%) | 12 (46.2%) |
| Female | 3 (75.0%) | 11 (50.0%) | 14 (53.8%) |
| Race | | | |
| Asian | 1 (25.0%) | 2 (9.1%) | 3 (11.5%) |
| Black or African American | 1 (25.0%) | 0 (0%) | 1 (3.8%) |
| White | 2 (50.0%) | 20 (90.9%) | 22 (84.6%) |
| Hispanic ethnicity | 0 (0%) | 1 (4.5%) | 1 (3.8%) |
| Insurance | | | |
| Private | 3 (75.0%) | 17 (77.3%) | 20 (76.9%) |
| Government | 1 (25.0%) | 5 (22.7%) | 6 (23.1%) |
| Housing Type | | | |
| House/condo/townhouse | 1 (25.0%) | 5 (22.7%) | 6 (23.1%) |
| Apartment | 3 (75.0%) | 17 (77.3%) | 20 (76.9%) |
| House members | | | |
| 2 people | 1 (25.0%) | 10 (45.5%) | 11 (42.3%) |
| 3 people | 1 (25.0%) | 1 (4.5%) | 2 (7.7%) |
| 4 people | 0 (0%) | 2 (9.1%) | 2 (7.7%) |
| 5 people | 0 (0%) | 2 (9.1%) | 2 (7.7%) |
| 6 or more people | 1 (25.0%) | 2 (9.1%) | 3 (11.5%) |
| I live by myself | 1 (25.0%) | 5 (22.7%) | 6 (23.1%) |
| Smoking | | | |
| Nonsmoker | 4 (100%) | 19 (86.4%) | 23 (88.5%) |
| Tobacco use | 0 (0%) | 3 (13.6%) | 3 (11.5%) |
| Electronic cigarettes/vapor pen use | 0 (0%) | 1 (4.5%) | 1 (3.8%) |
| Received 2019-2020 Influenza vaccine (N = 23) | 2 (50.0%) | 16 (72.7%) | 18 (69.2%) |
| Employed | | | |
| Retired | 1 (25.0%) | 0 (0%) | 1 (3.8%) |
| Self-employed | 1 (25.0%) | 4 (18.2%) | 5 (19.2%) |
| Unemployed | 0 (0%) | 2 (9.1%) | 2 (7.7%) |
| Yes, and I would be paid for hours missed | 2 (50.0%) | 12 (54.5%) | 14 (53.8%) |
| Yes, but I would not be paid for hours missed | 0 (0%) | 4 (18.2%) | 4 (15.4%) |
| Highest Level of Medical Treatment Received | | | |
| Outpatient - Testing Only | 0 (0%) | 15 (68.2%) | 15 (57.7%) |
| Outpatient - Saw Provider** | 0 (0%) | 7 (31.8%) | 7 (26.9%) |

TABLE 5-continued

| | Source of patient convalescent sera | | |
|---|---|---|---|
| | Hospitalized (N = 4) | Not Hospitalized (N = 22) | Overall (N = 26) |
| Inpatient (General Floor) | 2 (50.0%) | 0 (0%) | 2 (7.7%) |
| Inpatient (ICU) | 2 (50.0%) | 0 (0%) | 2 (7.7%) |
| Comorbidities* | | | |
| No comorbidities | 1 (25.0%) | 20 (90.9%) | 21 (80.8%) |
| Hypertension | 2 (50.0%) | 2 (9.1%) | 4 (15.4%) |
| Diabetes | 2 (50.0%) | 0 (0%) | 2 (7.7%) |
| Cardiovascular disease | 1 (25.0%) | 0 (0%) | 1 (3.8%) |
| Chronic kidney disease | 1 (25.0%) | 0 (0%) | 1 (3.8%) |
| Cardiovascular disease | 1 (25.0%) | 0 (0%) | 1 (3.8%) |
| HIV | 1 (25.0%) | 0 (0%) | 1 (3.8%) |
| Highest Level of Respiratory Support | | | |
| None | 1 (25.0%) | 22 (100%) | 23 (88.5%) |
| Non-invasive ventilation (BiPAP) | 1 (25.0%) | 0 (0%) | 1 (3.8%) |
| Mechanical ventilation/intubation | 2 (50.0%) | 0 (0%) | 2 (7.7%) |
| Travel out of state in last 30 days (N = 23) | 0 (0%) | 4 (18.2%) | 4 (15.4%) |
| Symptoms* | | | |
| Feeling feverish | 3 (75.0%) | 15 (68.2%) | 18 (69.2%) |
| Cough | 4 (100%) | 17 (77.3%) | 21 (80.8%) |
| Chills or shivering | 3 (75.0%) | 15 (68.2%) | 18 (69.2%) |
| Sweats | 2 (50.0%) | 14 (63.6%) | 16 (61.5%) |
| Sore throat or itchy/scratchy throat | 0 (0%) | 10 (45.5%) | 10 (38.5%) |
| Nausea or vomiting | 1 (25.0%) | 3 (13.6%) | 4 (15.4%) |
| Runny or stuffy nose | 1 (25.0%) | 13 (59.1%) | 14 (53.8%) |
| Muscle or body aches | 2 (50.0%) | 15 (68.2%) | 17 (65.4%) |
| Increased trouble breathing | 3 (75.0%) | 5 (22.7%) | 8 (30.8%) |
| Fatigue | 2 (50.0%) | 17 (77.3%) | 19 (73.1%) |
| Diarrhea | 2 (50.0%) | 6 (27.3%) | 8 (30.8%) |
| Rash | 0 (0%) | 1 (4.5%) | 1 (3.8%) |
| Ear pain or ear discharge | 0 (0%) | 1 (4.5%) | 1 (3.8%) |
| Loss of sense of taste or smell | 0 (0%) | 7 (31.8%) | 7 (26.9%) |

*Categories not mutually exclusive

**Includes Primary Care Physician, Urgent care, Emergency Department

We prototyped potential human antibody responses to the RBD nanoparticle immunogens using the Kymab proprietary IntelliSelect™ Transgenic mouse platform (known as 'Darwin') that is transgenic for the non-rearranged human antibody variable and constant region germline repertoire. In contrast to previous mice with chimeric antibody loci that have been described (Lee et al., 2014), the mice in the present study differed in that they were engineered to express fully human kappa light chain Abs. Groups of five Darwin mice were immunized intramuscularly with S-2P trimer, 100% RBD-12GS-, or 100% RBD-16GS-I53-50 nanoparticles at antigen doses of 0.9 μg (nanoparticles only) or 5 μg (FIG. 4C). All groups immunized with RBD nanoparticles elicited S-directed Ab responses post-prime ($EC_{50}$ $2\times10^3$-$1\times10^4$) that were substantially boosted by a second immunization at week 3 ($EC_{50}$ ranging from $4\times10^5$ to $8\times10^5$) (FIGS. 4C and 4D). In this animal model, the S-2P trimer elicited levels of S-specific Abs comparable to the RBD nanoparticles after each immunization.

We then evaluated the neutralizing activity elicited by each immunogen using both pseudovirus and live virus neutralization assays. In BALB/c mice, all RBD nanoparticle immunogens elicited serum neutralizing Abs after a single immunization, with reciprocal half-maximal inhibition dilutions (IC50) ranging from $1\times10^2$ to $5\times10^2$ (GMT) in pseudovirus and $3\times10^3$ to $7\times10^3$ in live virus neutralization assays (FIGS. 5A and 5C). No significant differences in pseudovirus or live virus neutralization were observed between low or high doses of RBD-8GS-, RBD-12GS-, or RBD-16GS-I53-50 nanoparticles at 50% (pseudovirus neutralization only) or 100% valency, in agreement with the S-specific Ab data. The GMT of all three 100% valency RBD nanoparticle groups matched or exceeded that of the panel of 29 HCS tested in the pseudovirus neutralization assay (FIG. 5A). Immunization with monomeric RBD or S-2P trimer did not elicit neutralizing Abs after a single immunization (FIGS. 5A and 5C). As in BALB/c mice, both high and low doses of the RBD-I53-50 nanoparticles in Darwin mice elicited pseudovirus neutralizing Ab titers (IC50 $8\times10^1$ to $2.5\times10^2$) comparable to HCS (IC50 $1\times10^2$) after a single immunization, whereas 5 μg of the S-2P trimer did not elicit detectable levels of neutralizing Abs (FIG. 5E) despite eliciting similar levels of total S-specific Abs.

In both mouse models, a second immunization with the RBD-I53-50 nanoparticles led to a large increase in neutralizing Ab titers. In BALB/c mice, pseudovirus neutralization GMT reached $2\times10^3$ to $3\times10^4$, exceeding that of the HCS by 1-2 orders of magnitude, and live virus neutralization titers reached $2\times10^4$ to $3\times10^4$ (FIGS. 5B and 5D). A second immunization with 5 μg of the S-2P trimer also strongly boosted neutralizing activity, although pseudovirus and live virus neutralization (GMTs of $3\times10^2$ and $6\times10^3$, respectively) were still lower than in sera from animals immunized with the RBD nanoparticles. The increases between the S-2P trimer and the RBD nanoparticles ranged from 7-90-fold and 4-9-fold in the pseudovirus and live virus neutralization assays, respectively. The 0.9 μg dose of the S-2P trimer and both doses of the monomeric RBD failed to elicit detectable neutralization after two immunizations. Similar increases in pseudovirus neutralization were observed after the second immunization in the Darwin mice, although the titers were lower overall than in BALB/c mice (FIG. 5F).

Figure 2:
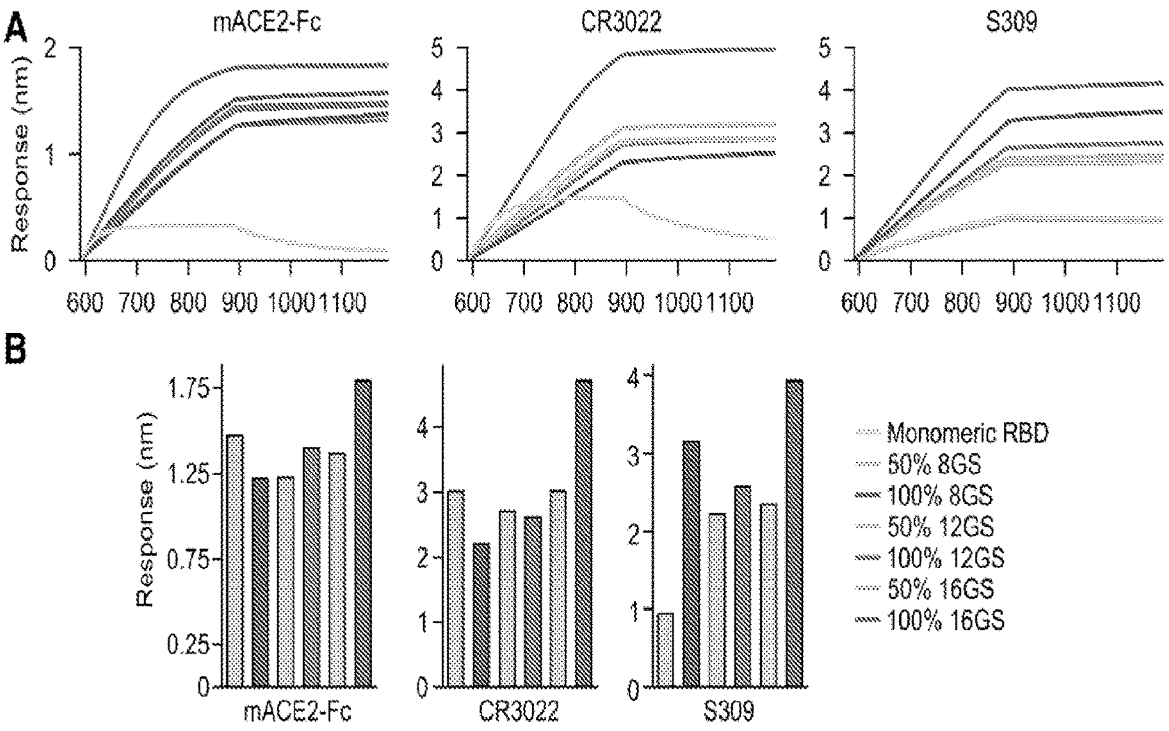
FIG. 2 (A-B). Antigenic Characterization of SARS-COV-2 RBD-I53-50 Nanoparticle Immunogens (A) Bio-layer interferometry of immobilized mACE2-Fc, CR3022 mAb, and S309 mAb binding to RBD-8GS-, RBD-12GS-, and RBD-16GS-I53-50 nanoparticles displaying the RBD antigen at 50% or 100% valency. The monomeric SARS-CoV-2 RBD was included in each experiment as a reference. (B) The binding signal at 880 s, near the end of the association phase, is plotted for each experiment in panel (A) to enable comparison of the binding signal obtained from each nanoparticle.
Figure 3:
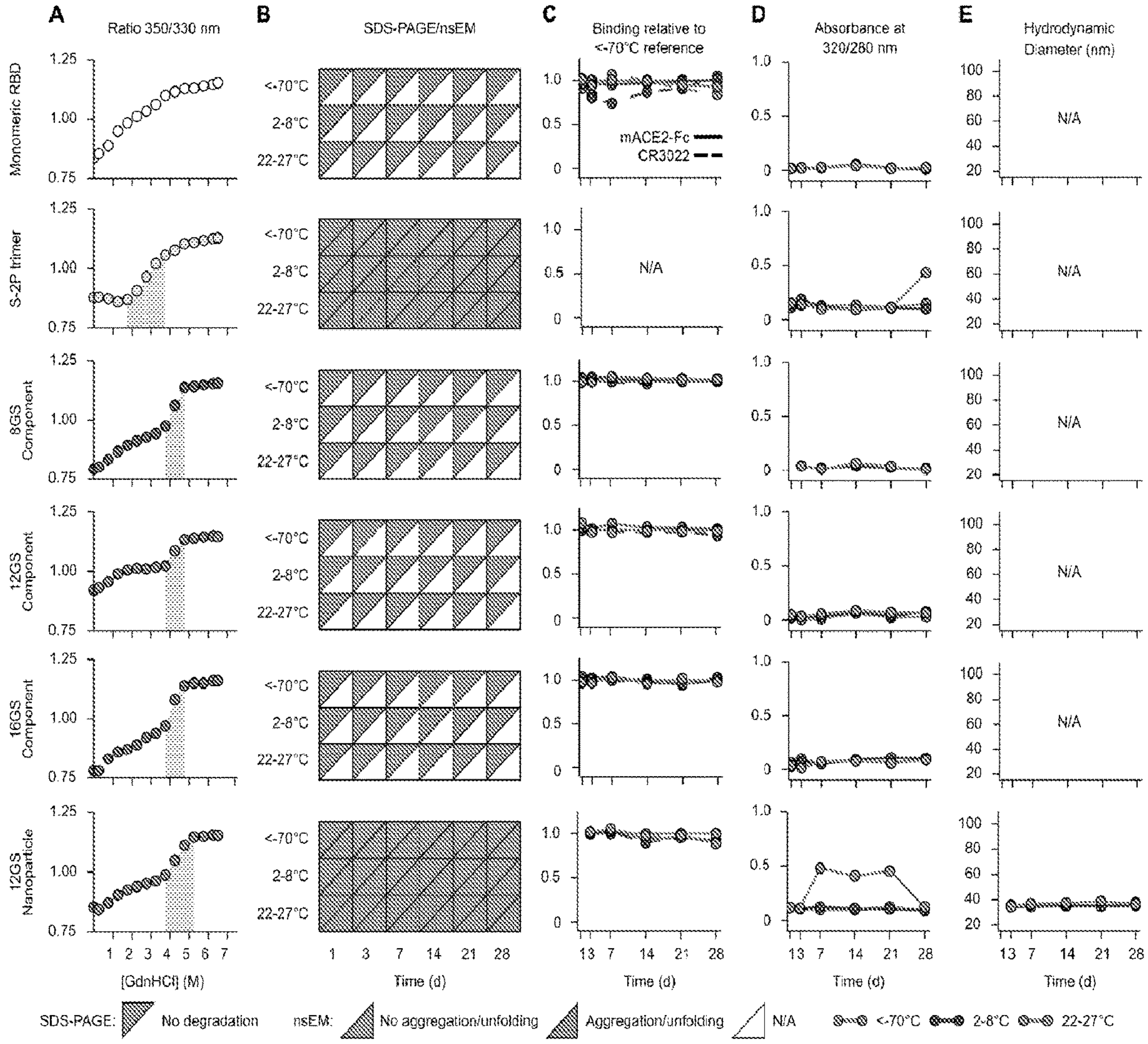
FIG. 3 (A-E). Physical and Antigenic Stability of RBD Nanoparticle Immunogens and S-2P Trimer (A) Chemical denaturation by guanidine hydrochloride. The ratio of intrinsic tryptophan fluorescence emission at 350/320 nm was used to monitor protein tertiary structure. Major transitions are indicated by shaded regions. Representative data from one of three independent experiments are shown. (B) Summary of SDS-PAGE and nsEM stability data over four weeks. SDS-PAGE showed no detectable degradation in any sample. nsEM revealed substantial unfolding of the S-2P trimer at 2-8° C. after three days incubation, and at 22-27° C. after four weeks. N/A, not assessed. (C) Summary of antigenicity data over four weeks. The antigens were analyzed for mACE2-Fc (solid lines) and CR3022 mAb (dashed lines) binding by bio-layer interferometry after storage at the various temperatures. The plotted value represents the amplitude of the signal near the end of the association phase normalized to the corresponding <−70° C. sample at each time point. (D) Summary of UV/vis stability data over four weeks. The ratio of absorbance at 320/280 nm is plotted as a measure of particulate scattering. Only the S-2P trimer and the RBD-12GS-I53-50 nanoparticle showed any increase in scattering, and only at ambient temperature. (E) DLS of the RBD-12GS-I53-50 nanoparticle indicated a monodisperse species with no detectable aggregate at all temperatures and time points. The data in panels B-E is from a four-week real-time stability study that was performed once.

Several conclusions can be drawn from these data. First, the RBD nanoparticles elicit potent neutralizing Ab responses in two mouse models that exceed those elicited by the prefusion-stabilized S-2P trimer and, after two doses, by infection in humans. Second, linker length and antigen valency did not substantially impact the overall immunogenicity of the RBD nanoparticles, although there is a trend suggesting that RBD-16GS-I53-50 may be more immunogenic than the nanoparticles with shorter linkers. These observations are consistent with the antigenicity and accessibility data presented in Table 4 and FIG. 2 showing that multiple epitopes are intact and accessible in all RBD nanoparticle immunogens. Finally, the elicitation of comparable neutralizing Ab titers by both the 0.9 and 5 μg doses of each nanoparticle immunogen suggests that RBD presentation on the I53-50 nanoparticle enables dose sparing, which is a key consideration for vaccine manufacturing and distribution.

Eight mice immunized with AddaVax™ only, monomeric RBD, S-2P trimer, or RBD-8GS- or RBD-12GS-I53-50 nanoparticles were challenged seven weeks post-boost with a mouse-adapted SARS-COV-2 virus (SARS-COV-2 MA) to determine whether these immunogens confer protection from viral replication. The RBD-8GS- and RBD-12GS-I53-50 nanoparticles provided complete protection from detectable SARS-COV-2 MA replication in mouse lung and nasal turbinates (FIG. 5G-H). Immunization with the monomeric RBD, 0.9 μg S-2P trimer, and adjuvant control did not protect from SARS-COV-2 MA replication. These results mirrored our pseudovirus and live virus neutralization data showing that the RBD nanoparticles induce potent anti-SARS-COV-2 Ab responses at either dose or valency.

Figure 12:
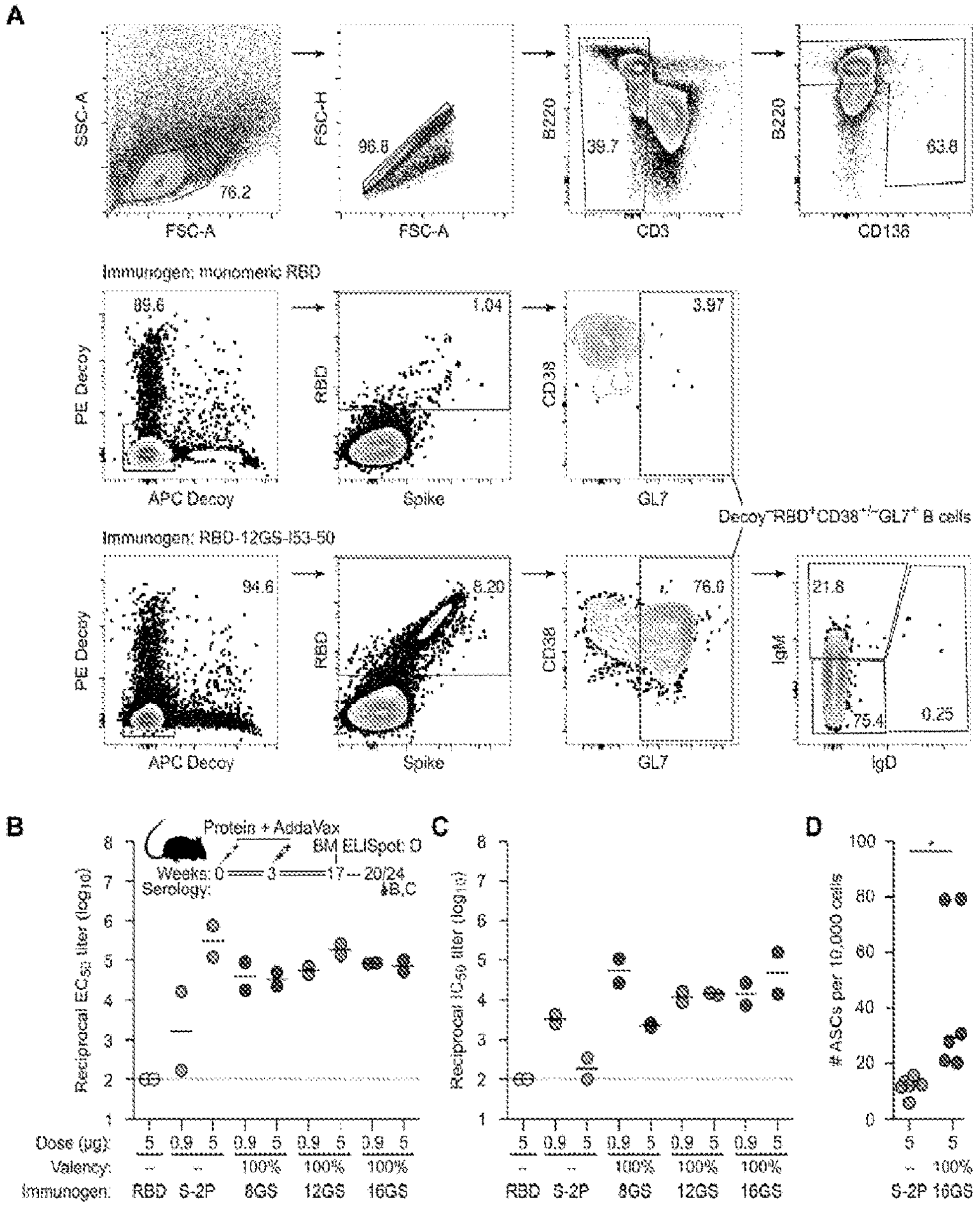
FIG. 12 (A-D). B Cell Gating Strategy and Durability of the Vaccine-Elicited Immune Response. (A) Representative gating strategy for evaluating RBD-specific B cells, germinal center (GC) precursors and B cells (CD38+/−GL7+), and B cell isotypes. Top row, gating strategy for measuring numbers of live, non-doublet B cells. These cells were further analyzed as depicted in the middle and bottom rows. Middle row, representative data from a mouse immunized with the monomeric RBD formulated with AddaVax™. RBD+CD38+/−GL7+ cells that did not bind decoys were counted as antigen-specific GC precursors and B cells. Bottom row, representative data from a mouse immunized with the RBD-12GS-I53-50 nanoparticle formulated with AddaVax™. GC precursors and B cells were further analyzed to characterize B cell receptor isotypes. (B-C) Levels of (B)S-specific IgG and (C) pseudovirus neutralization in sera collected 20 (RBD-16GS-I53-50) or 24 (monomeric RBD, S-2P, RBD-8GS-I53-50, and RBD-12GS-I53-50) weeks post-boost. Sera were collected from the two animals from each group that were not challenged with MA-SARS-COV-2. (D) Numbers of S-2P-specific Ab secreting cells in the bone marrow of BALB/c mice immunized with either S-2P trimer or RBD-16GS-I53-50 nanoparticle, measured by ELISpot. Cells were harvested 17 weeks post-boost (see panel B inset). The animal experiment was performed once. Statistical significance was determined by two-tailed unpaired t test. *, p=0.02.

RBD Nanoparticle Vaccines Elicit Robust B Cell Responses and Antibodies Targeting Multiple Epitopes in Mice and a Nonhuman Primate Germinal center (GC) responses are a key process in the formation of durable B cell memory, resulting in the formation of affinity-matured, class-switched memory B cells and long-lived plasma cells. We therefore evaluated the antigen-specific GC B cell responses in mice immunized with the monomeric RBD, S-2P trimer, and RBD-8GS-, RBD-12GS-, or RBD-16GS-I53-50 nanoparticles. The quantity and phenotype of RBD-specific B cells were assessed 11 days after immunization to determine levels of GC precursors and B cells ($B220^+CD3^-CD138^-CD38^-GL7^+$) (FIG. 12). Immunization with RBD nanoparticles resulted in an expansion of RBD-specific B cells and GC precursors and B cells (FIG. 6A-C). The S-2P trimer resulted in a detectable but lower number and frequency of RBD-specific B cells and GC precursors and B cells compared to the RBD nanoparticles, whereas the monomeric RBD construct did not elicit an appreciable B cell response. Consistent with these findings, immunization with the three RBD nanoparticles and trimeric S-2P led to the emergence of $CD38^{+/-}GL7^+$ $IgM^+$ and class-switched ($swIg^+$) RBD-specific B cells, indicative of functional GC precursors and GC B cells (FIG. 6D). The robust GC B cell responses and increased proportions of $IgM^+$ and $swIg^+$RBD-specific B cells in the mice immunized with the RBD-nanoparticles and, to a lesser extent, S-2P constructs is consistent with an ongoing GC reaction, which in time should result in the formation of memory B cells and long-lived plasma cells. To evaluate the durability of humoral responses elicited by the RBD nanoparticle vaccines, we analyzed serum Ab responses 20-24 weeks post-boost. The magnitude of both binding and neutralization titers were similar to their levels two weeks post-boost for all nanoparticle groups (FIGS. 12B,C), indicating that the designed immunogens elicit not only potent but also durable neutralizing Abs. This is likely due in part to improved induction of long-lived plasma cells by the nanoparticle vaccines, as the number of S-2P-specific Ab secreting cells in the bone marrow was ~3-fold higher for mice immunized with the RBD-16GS-I53-50 nanoparticle compared to the S-2P trimer (FIG. 12D).

We compared the ratio of binding to neutralizing antibodies elicited by the S-2P and the RBD-8GS-, RBD-12GS-, and RBD-16GS-I53-50 nanoparticles and HCS as a measure of the quality of the Ab responses elicited by the nanoparticle immunogens. In Kymab Darwin™ mice, the nanoparticle vaccines had lower (better) ratios than S-2P-immunized mice, but higher than HCS (FIG. 6E). In BALB/c mice, the ratio of binding to pseudovirus neutralizing titers elicited by RBD-12GS- and RBD-16GS-I53-50 was clearly decreased compared to S-2P and HCS (FIG. 6F). This pattern was consistent when ratios were calculated using live virus neutralizing titers, although the magnitude of the differences between groups was smaller due to the high values obtained in the live virus neutralization assay. These results suggest the Ab responses elicited by the RBD-12GS- and RBD-16GS-153-50 nanoparticle immunogens are of higher quality than that obtained from immunization with the S-2P trimer or acquired during natural infection, perhaps because it is focused on epitopes in the RBD that are the target of most neutralizing Abs.

We set out to identify the epitopes recognized by Abs elicited upon immunization with the nanoparticle immunogens in a nonhuman primate model that more closely resembles humans in their immune response to vaccination. We immunized a pigtail macaque with 250 μg of RBD-12GS-I53-50 (88 μg of RBD antigen) at weeks 0 and 4 and found that serum collected at week 8 had high levels of S-specific Abs ($EC_{50}$~$1\times10^6$). Polyclonal Fabs were generated and purified for use in competition BLI with hACE2, CR3022, and S309, which recognize three distinct sites targeted by neutralizing Abs on the SARS-COV-2 RBD (FIG. 6G). The polyclonal sera inhibited binding of hACE2, CR3022 Fab, and S309 Fab at concentrations above their respective dissociation constants in a dose-dependent manner (FIG. 6H-J). These data indicate that immunization with 12GS-RBD-I53-50 elicited Abs targeting several non-overlapping epitopes, which we expect to limit the potential for emergence and selection of escape mutants, especially since coronaviruses do not mutate quickly when compared to viruses such as influenza or human immunodeficiency virus (Li et al., 2020; Smith et al., 2014).

Discussion

Here we showed that two-component self-assembling SARS-COV-2 RBD nanoparticle vaccine candidates elicit potent neutralizing Ab responses targeting multiple distinct RBD epitopes. The greater neutralizing Ab responses elicited by the RBD nanoparticles compared to the prefusion-stabilized ectodomain trimer are very promising. Our data indicate that RBD-12GS-I53-50 and RBD-16GS-I53-50 elicit nearly ten-fold higher levels of S-specific Abs and, more importantly, roughly ten-fold higher levels of neutralizing activity compared to the S-2P ectodomain trimer. This enhancement in potency is maintained at a more than five-fold lower antigen dose by mass, suggesting that presentation on the nanoparticle also has a dose-sparing effect. Both enhanced potency and dose-sparing could be critical for addressing the need to manufacture an unprecedented number of doses of vaccine to respond to the SARS-COV-2 pandemic.

Although the RBD is poorly immunogenic as a monomer, our data establish that it can form the basis of a highly immunogenic vaccine when presented multivalently in our designs. The exceptionally low binding: neutralizing ratio elicited upon immunization with the RBD nanoparticles suggests that presentation of the RBD on I53-50 focuses the humoral response on epitopes recognized by neutralizing Abs. This metric is a potentially important indicator of vaccine safety, as high levels of binding yet non-neutralizing or weakly neutralizing Abs may contribute to vaccine-associated enhancement of respiratory disease. Our data further show that RBD-12GS-I53-50 elicited Ab responses targeting several of the non-overlapping epitopes recognized by neutralizing Abs that have been identified in the RBD. Such polyclonal responses targeting multiple distinct epitopes might explain the magnitude of neutralization observed and should minimize the risk of selection or emergence of escape mutations. Finally, the high production yield of RBD-I53-50A components and the robust stability of the antigen-bearing RBD nanoparticles makes them amenable to large-scale manufacturing.

REFERENCES

Alsoussi, W. B., Turner, J. S., Case, J. B., Zhao, H., Schmitz, A. J., Zhou, J. Q., Chen, R. E., Lei, T., Rizk, A. A., McIntire, K. M., et al. (2020). A Potently Neutralizing Antibody Protects Mice against SARS-COV-2 Infection. J Immunol.

Anthony, S. J., Gilardi, K., Menachery, V. D., Goldstein, T., Ssebide, B., Mbabazi, R., Navarrete-Macias, I., Liang, E., Wells, H., Hicks, A., et al. (2017). Further Evidence for Bats as the Evolutionary Source of Middle East Respiratory Syndrome Coronavirus. MBio 8.

Anywaine, Z., Whitworth, H., Kaleebu, P., Praygod, G., Shukarev, G., Manno, D., Kapiga, S., Grosskurth, H., Kalluvya, S., Bockstal, V., et al. (2019). Safety and Immunogenicity of a 2-Dose Heterologous Vaccination Regimen With Ad26.ZEBOV and MVA-BN-Filo Ebola Vaccines: 12-Month Data From a Phase 1 Randomized Clinical Trial in Uganda and Tanzania. J Infect Dis 220, 46-56.

Bale, J. B., Gonen, S., Liu, Y., Sheffler, W., Ellis, D., Thomas, C., Cascio, D., Yeates, T. O., Gonen, T., King, N. P., et al. (2016). Accurate design of megadalton-scale two-component icosahedral protein complexes. Science 353, 389-394.

Barnes, C. O., West, A. P., Huey-Tubman, K. E., Hoffmann, M. A. G., Sharaf, N. G., Hoffman, P. R., Koranda, N., Gristick, H. B., Gaebler, C., Muecksch, F., et al. (2020). Structures of Human Antibodies Bound to SARS-COV-2 Spike Reveal Common Epitopes and Recurrent Features of Antibodies. Cell.

Boyoglu-Barnum, S., Ellis, D., Gillespie, R. A., Hutchinson, G. B., Park, Y.-J., Moin, S. M., Acton, O., Ravichandran, R., Murphy, M., Pettie, D., et al. (2020). Elicitation of broadly protective immunity to influenza by multivalent hemagglutinin nanoparticle vaccines. bioRxiv, 2020.2005.2030.125179.

Brouwer, P. J. M., Antanasijevic, A., Berndsen, Z., Yasmeen, A., Fiala, B., Bijl, T. P. L., Bontjer, I., Bale, J. B., Sheffler, W., Allen, J. D., et al. (2019). Enhancing and shaping the immunogenicity of native-like HIV-1 envelope trimers with a two-component protein nanoparticle. Nat Commun 10, 4272.

Brouwer, P. J. M., Caniels, T. G., van der Straten, K., Snitselaar, J. L., Aldon, Y., Bangaru, S., Torres, J. L., Okba, N. M. A., Claireaux, M., Kerster, G., et al. (2020). Potent neutralizing antibodies from COVID-19 patients define multiple targets of vulnerability. Science.

Bruun, T. U. J., Andersson, A. C., Draper, S. J., and Howarth, M. (2018). Engineering a Rugged Nanoscaffold To Enhance Plug-and-Display Vaccination. ACS Nano 12, 8855-8866.

Corbett, K. S., Edwards, D. K., Leist, S. R., Abiona, O. M., Boyoglu-Barnum, S., Gillespie, R. A., Himansu, S., Schäfer, A., Ziwawo, C. T., DiPiazza, A. T., et al. (2020). SARS-COV-2 mRNA vaccine design enabled by prototype pathogen preparedness. Nature.

Corti, D., Zhao, J., Pedotti, M., Simonelli, L., Agnihothram, S., Fett, C., Fernandez-Rodriguez, B., Foglierini, M., Agatic, G., Vanzetta, F., et al. (2015). Prophylactic and postexposure efficacy of a potent human monoclonal antibody against MERS coronavirus. Proc Natl Acad Sci USA 112, 10473-10478.

Dai, L., Zheng, T., Xu, K., Han, Y., Xu, L., Huang, E., An, Y., Cheng, Y., Li, S., Liu, M., et al. (2020). A Universal Design of Betacoronavirus Vaccines against COVID-19, MERS, and SARS. Cell.

Davis, A. K. F., McCormick, K., Gumina, M. E., Petrie, J. G., Martin, E. T., Xue, K. S., Bloom, J. D., Monto, A. S., Bushman, F. D., and Hensley, S. E. (2018). Sera from Individuals with Narrowly Focused Influenza Virus Antibodies Rapidly Select Viral Escape Mutations. J Virol 92.

Dinnon, K. H., Leist, S. R., Schäfer, A., Edwards, C. E., Martinez, D. R., Montgomery, S. A., West, A., Yount, B. L., Hou, Y. J., Adams, L. E., et al. (2020). A mouse-adapted SARS-COV-2 model for the evaluation of COVID-19 medical countermeasures. bioRxiv, 2020.2005.2006.081497.

Edwards, R. J., Mansouri, K., Stalls, V., Manne, K., Watts, B., Parks, R., Gobeil, S. M. C., Janowska, K., Li, D., Lu, X., et al. (2020). Cold sensitivity of the SARS-COV-2 spike ectodomain. bioRxiv.

Erasmus, J. H., Khandhar, A. P., O'Connor, M. A., Walls, A. C., Hemann, E. A., Murapa, P., Archer, J., Leventhal, S., Fuller, J. T., Lewis, T. B., et al. (2020). An Alphavirus-derived replicon RNA vaccine induces SARS-COV-2 neutralizing antibody and T cell responses in mice and nonhuman primates. Sci Transl Med 12.

Folegatti, P. M., Ewer, K. J., Aley, P. K., Angus, B., Becker, S., Belij-Rammerstorfer, S., Bellamy, D., Bibi, S., Bittaye, M., Clutterbuck, E. A., et al. (2020). Safety and immunogenicity of the ChAdOx1 nCOV-19 vaccine against SARS-COV-2: a preliminary report of a phase 1/2, single-blind, randomised controlled trial. Lancet.

Gibson, D. G., Young, L., Chuang, R. Y., Venter, J. C., Hutchison, C. A., and Smith, H. O. (2009). Enzymatic assembly of DNA molecules up to several hundred kilobases. Nat Methods 6, 343-345.

Goddard, T. D., Huang, C. C., Meng, E. C., Pettersen, E. F., Couch, G. S., Morris, J. H., and Ferrin, T. E. (2018). UCSF ChimeraX: Meeting modern challenges in visualization and analysis. Protein Sci 27, 14-25.

Graham, B. S. (2020). Rapid COVID-19 vaccine development. Science 368, 945-946. Guttman, M., Weis, D. D., Engen, J. R., and Lee, K. K. (2013). Analysis of overlapped and noisy hydrogen/deuterium exchange mass spectra. J Am Soc Mass Spectrom 24, 1906-1912.

Henderson, R., Edwards, R. J., Mansouri, K., Janowska, K., Stalls, V., Gobeil, S. M. C., Kopp, M., Li, D., Parks, R., Hsu, A. L., et al. (2020). Controlling the SARS-COV-2 spike glycoprotein conformation. Nat Struct Mol Biol.

Hoffmann, M., Kleine-Weber, H., Schroeder, S., Krüger, N., Herrler, T., Erichsen, S., Schiergens, T. S., Herrler, G., Wu, N. H., Nitsche, A., et al. (2020). SARS-COV-2 Cell Entry Depends on ACE2 and TMPRSS2 and Is Blocked by a Clinically Proven Protease Inhibitor. Cell 181, 271-280.e278.

Hou, Y. J., Okuda, K., Edwards, C. E., Martinez, D. R., Asakura, T., Dinnon, K. H., Kato, T., Lee, R. E., Yount, B. L., Mascenik, T. M., et al. (2020). SARS-COV-2 Reverse Genetics Reveals a Variable Infection Gradient in the Respiratory Tract. Cell 182, 429-446.e414.

Hsia, Y., Bale, J. B., Gonen, S., Shi, D., Sheffler, W., Fong, K. K., Nattermann, U., Xu, C., Huang, P. S., Ravichandran, R., et al. (2016). Design of a hyperstable 60-subunit protein dodecahedron. [corrected]. Nature 535, 136-139.

Hsieh, C. L., Goldsmith, J. A., Schaub, J. M., DiVenere, A. M., Kuo, H. C., Javanmardi, K., Le, K. C., Wrapp, D., Lee, A. G., Liu, Y., et al. (2020). Structure-based design of prefusion-stabilized SARS-CoV-2 spikes. Science.

Huo, J., Zhao, Y., Ren, J., Zhou, D., Duyvesteyn, H. M. E., Ginn, H. M., Carrique, L., Malinauskas, T., Ruza, R. R., Shah, P. N. M., et al. (2020). Neutralisation of SARS-COV-2 by destruction of the prefusion Spike. Cell Host & Microbe.

Irvine, D. J., and Read, B. J. (2020). Shaping humoral immunity to vaccines through antigen-displaying nanoparticles. Curr Opin Immunol 65, 1-6.

Jackson, L. A., Anderson, E. J., Rouphael, N. G., Roberts, P. C., Makhene, M., Coler, R. N., Mccullough, M. P., Chappell, J. D., Denison, M. R., Stevens, L. J., et al. (2020). An mRNA Vaccine against SARS-COV-2-Preliminary Report. N Engl J Med.

Kanekiyo, M., Bu, W., Joyce, M. G., Meng, G., Whittle, J. R., Baxa, U., Yamamoto, T., Narpala, S., Todd, J. P., Rao, S. S., et al. (2015). Rational Design of an Epstein-Barr Virus Vaccine Targeting the Receptor-Binding Site. Cell 162, 1090-1100.

Kanekiyo, M., Ellis, D., and King, N. P. (2019a). New Vaccine Design and Delivery Technologies. J Infect Dis 219, S88-S96.

Kanekiyo, M., and Graham, B. S. (2020). Next-Generation Influenza Vaccines. Cold Spring Harb Perspect Med.

Kanekiyo, M., Joyce, M. G., Gillespie, R. A., Gallagher, J. R., Andrews, S. F., Yassine, H. M., Wheatley, A. K., Fisher, B. E., Ambrozak, D. R., Creanga, A., et al. (2019b). Mosaic nanoparticle display of diverse influenza virus hemagglutinins elicits broad B cell responses. Nat Immunol 20, 362-372.

Kanekiyo, M., Wei, C. J., Yassine, H. M., McTamney, P. M., Boyington, J. C., Whittle, J. R., Rao, S. S., Kong, W. P., Wang, L., and Nabel, G. J. (2013). Self-assembling influenza nanoparticle vaccines elicit broadly neutralizing H1N1 antibodies. Nature 499, 102-106.

Keech, C., Albert, G., Reed, P., Neal, S., Plested, J. S., Zhu, M., Cloney-Clark, S., Zhou, H., Patel, N., Frieman, M. B., et al. (2020). First-in-Human Trial of a SARS COV 2 Recombinant Spike Protein Nanoparticle Vaccine. bioRxiv, 2020.08.05.20168435.

Kim, H. W., Canchola, J. G., Brandt, C. D., Pyles, G., Chanock, R. M., Jensen, K., and Parrott, R. H. (1969). Respiratory syncytial virus disease in infants despite prior administration of antigenic inactivated vaccine. Am J Epidemiol 89, 422-434.

King, N. P., Sheffler, W., Sawaya, M. R., Vollmar, B. S., Sumida, J. P., Andre, I., Gonen, T., Yeates, T. O., and Baker, D. (2012). Computational design of self-assembling protein nanomaterials with atomic level accuracy. Science 336, 1171-1174.

Kirchdoerfer, R. N., Wang, N., Pallesen, J., Wrapp, D., Turner, H. L., Cottrell, C. A., Corbett, K. S., Graham, B. S., Mclellan, J. S., and Ward, A. B. (2018). Stabilized coronavirus spikes are resistant to conformational changes induced by receptor recognition or proteolysis. Sci Rep 8, 15701.

Kreimer, A. R., Herrero, R., Sampson, J. N., Porras, C., Lowy, D. R., Schiller, J. T., Schiffman, M., Rodriguez, A. C., Chanock, S., Jimenez, S., et al. (2018). Evidence for single-dose protection by the bivalent HPV vaccine-Review of the Costa Rica HPV vaccine trial and future research studies. Vaccine 36, 4774-4782.

Krenkova, J., Szekrenyes, A., Keresztessy, Z., Foret, F., and Guttman, A. (2013). Oriented immobilization of peptide-N-glycosidase F on a monolithic support for glycosylation analysis. J Chromatogr A 1322, 54-61.

Krishnamurty, A. T., Thouvenel, C. D., Portugal, S., Keitany, G. J., Kim, K. S., Holder, A., Crompton, P. D., Rawlings, D. J., and Pepper, M. (2016). Somatically Hypermutated *Plasmodium*-Specific IgM (+) Memory B Cells Are Rapid, Plastic, Early Responders upon Malaria Rechallenge. Immunity 45, 402-414.

Kumru, O. S., Joshi, S. B., Smith, D. E., Middaugh, C. R., Prusik, T., and Volkin, D. B. (2014). Vaccine instability in the cold chain: mechanisms, analysis and formulation strategies. Biologicals 42, 237-259.

Lan, J., Ge, J., Yu, J., Shan, S., Zhou, H., Fan, S., Zhang, Q., Shi, X., Wang, Q., Zhang, L., et al. (2020). Structure of the SARS-COV-2 spike receptor-binding domain bound to the ACE2 receptor. Nature.

Lee, E. C., Liang, Q., Ali, H., Bayliss, L., Beasley, A., Bloomfield-Gerdes, T., Bonoli, L., Brown, R., Campbell, J., Carpenter, A., et al. (2014). Complete humanization of the mouse immunoglobulin loci enables efficient therapeutic antibody discovery. Nat Biotechnol 32, 356-363.

Lee, J. M., Eguia, R., Zost, S. J., Choudhary, S., Wilson, P. C., Bedford, T., Stevens-Ayers, T., Boeckh, M., Hurt, A. C., Lakdawala, S. S., et al. (2019). Mapping person-to-person variation in viral mutations that escape polyclonal serum targeting influenza hemagglutinin. Elife 8.

Letko, M., Marzi, A., and Munster, V. (2020). Functional assessment of cell entry and receptor usage for SARS-COV-2 and other lineage B betacoronaviruses. Nature Microbiology.

Li, W., Moore, M. J., Vasilieva, N., *Sui*, J., Wong, S. K., Berne, M. A., Somasundaran, M., Sullivan, J. L., Luzuriaga, K., Greenough, T. C., et al. (2003). Angiotensin-converting enzyme 2 is a functional receptor for the SARS coronavirus. Nature 426, 450-454.

Li, X., Wang, W., Zhao, X., Zai, J., Zhao, Q., Li, Y., and Chaillon, A. (2020). Transmission dynamics and evolutionary history of 2019-nCOV. J Med Virol 92, 501-511.

Lopez-Sagaseta, J., Malito, E., Rappuoli, R., and Bottomley, M. J. (2016). Self-assembling protein nanoparticles in the design of vaccines. Comput Struct Biotechnol J 14, 58-68.

Mandolesi, M., Sheward, D. J., Hanke, L., Ma, J., Pushparaj, P., Vidakovics, L. P., Kim, C., Loré, K., Dopico, X. C., Coquet, J. M., et al. (2020). SARS-COV-2 protein subunit vaccination elicits potent neutralizing antibody responses. bioRxiv, 2020.2007.2031.228486.

Marcandalli, J., Fiala, B., Ols, S., Perotti, M., de van der Schueren, W., Snijder, J., Hodge, E., Benhaim, M., Ravichandran, R., Carter, L., et al. (2019). Induction of Potent Neutralizing Antibody Responses by a Designed Protein Nanoparticle Vaccine for Respiratory Syncytial Virus. Cell 176, 1420-1431 e1417.

McCallum, M., Walls, A. C., Bowen, J. E., Corti, D., and Veesler, D. (2020). Structure-guided covalent stabilization of coronavirus spike glycoprotein trimers in the closed conformation. Nat Struct Mol Biol.

Menachery, V. D., Yount, B. L., Jr., Debbink, K., Agnihothram, S., Gralinski, L. E., Plante, J. A., Graham, R. L., Scobey, T., Ge, X. Y., Donaldson, E. F., et al. (2015). A SARS-like cluster of circulating bat coronaviruses shows potential for human emergence. Nat Med 21, 1508-1513.

Menachery, V. D., Yount, B. L., Jr., Sims, A. C., Debbink, K., Agnihothram, S. S., Gralinski, L. E., Graham, R. L., Scobey, T., Plante, J. A., Royal, S. R., et al. (2016). SARS-like WIV1-CoV poised for human emergence. Proc Natl Acad Sci USA 113, 3048-3053.

Millet, J. K., and Whittaker, G. R. (2016). Murine Leukemia Virus (MLV)-based Coronavirus Spike-pseudotyped Particle Production and Infection. Bio Protoc 6.

Mulligan, M. J., Lyke, K. E., Kitchin, N., Absalon, J., Gurtman, A., Lockhart, S. P., Neuzil, K., Raabe, V., Bailey, R., Swanson, K. A., et al. (2020). Phase 1/2 Study to Describe the Safety and Immunogenicity of a COVID-19 RNA Vaccine Candidate (BNT162b1) in Adults 18 to 55 Years of Age: Interim Report. medRxiv, 2020.2006.2030.20142570.

Pallesen, J., Wang, N., Corbett, K. S., Wrapp, D., Kirchdoerfer, R. N., Turner, H. L., Cottrell, C. A., Becker, M. M., Wang, L., Shi, W., et al. (2017). Immunogenicity and structures of a rationally designed prefusion MERS-COV spike antigen. Proc Natl Acad Sci USA 114, E7348-E7357.

Pinto, D., Park, Y. J., Beltramello, M., Walls, A. C., Tortorici, M. A., Bianchi, S., Jaconi, S., Culap, K., Zatta, F., De Marco, A., et al. (2020). Cross-neutralization of SARS-COV-2 by a human monoclonal SARS-COV antibody. Nature 583, 290-295.

Poh, C. M., Carissimo, G., Wang, B., Amrun, S. N., Lee, C. Y., Chee, R. S., Fong, S. W., Yeo, N. K., Lee, W. H., Torres-Ruesta, A., et al. (2020). Two linear epitopes on the SARS-COV-2 spike protein that elicit neutralising antibodies in COVID-19 patients. Nat Commun 11, 2806.

Polack, F. P., Teng, M. N., Collins, P. L., Prince, G. A., Exner, M., Regele, H., Lirman, D. D., Rabold, R., Hoffman, S. J., Karp, C. L., et al. (2002). A role for immune complexes in enhanced respiratory syncytial virus disease. J Exp Med 196, 859-865.

Robbiani, D. F., Gaebler, C., Muecksch, F., Lorenzi, J. C. C., Wang, Z., Cho, A., Agudelo, M., Barnes, C. O., Gazumyan, A., Finkin, S., et al. (2020). Convergent antibody responses to SARS-COV-2 in convalescent individuals. Nature.

Rockx, B., Corti, D., Donaldson, E., Sheahan, T., Stadler, K., Lanzavecchia, A., and Baric, R. (2008). Structural basis for potent cross-neutralizing human monoclonal antibody protection against lethal human and zoonotic severe acute respiratory syndrome coronavirus challenge. J Virol 82, 3220-3235.

Rossen, J. W., de Beer, R., Godeke, G. J., Raamsman, M. J., Horzinek, M. C., Vennema, H., and Rottier, P. J. (1998). The viral spike protein is not involved in the polarized sorting of coronaviruses in epithelial cells. J Virol 72, 497-503.

Sahin, U., Muik, A., Derhovanessian, E., Vogler, I., Kranz, L. M., Vormehr, M., Baum, A., Pascal, K., Quandt, J., Maurus, D., et al. (2020). Concurrent human antibody and T<sub>H</sub>1 type T-cell responses elicited by a COVID-19 RNA vaccine. medRxiv, 2020.2007.2017.20140533.

Seydoux, E., Homad, L. J., MacCamy, A. J., Parks, K. R., Hurlburt, N. K., Jennewein, M. F., Akins, N. R., Stuart, A. B., Wan, Y.-H., Feng, J., et al. (2020). Characterization of neutralizing antibodies from a SARS-COV-2 infected individual. bioRxiv, 2020.2005.2012.091298.

Shang, J., Ye, G., Shi, K., Wan, Y., Luo, C., Aihara, H., Geng, Q., Auerbach, A., and Li, F. (2020). Structural basis of receptor recognition by SARS-COV-2. Nature.

Smith, E. C., Sexton, N. R., and Denison, M. R. (2014). Thinking Outside the Triangle: Replication Fidelity of the Largest RNA Viruses. Annu Rev Virol 1, 111-132.

Stettler, K., Beltramello, M., Espinosa, D. A., Graham, V., Cassotta, A., Bianchi, S., Vanzetta, F., Minola, A., Jaconi, S., Mele, F., et al. (2016). Specificity, cross-reactivity, and function of antibodies elicited by Zika virus infection. Science 353, 823-826.

Taylor, J. J., Martinez, R. J., Titcombe, P. J., Barsness, L. O., Thomas, S. R., Zhang, N., Katzman, S. D., Jenkins, M. K., and Mueller, D. L. (2012). Deletion and anergy of polyclonal B cells specific for ubiquitous membrane-bound self-antigen. J Exp Med 209, 2065-2077.

ter Meulen, J., van den Brink, E. N., Poon, L. L., Marissen, W. E., Leung, C. S., Cox, F., Cheung, C. Y., Bakker, A. Q., Bogaards, J. A., van Deventer, E., et al. (2006). Human monoclonal antibody combination against SARS coronavirus: synergy and coverage of escape mutants. PLOS Med 3, e237.

Tortorici, M. A., and Veesler, D. (2019). Structural insights into coronavirus entry. Adv Virus Res 105, 93-116.

Traggiai, E., Becker, S., Subbarao, K., Kolesnikova, L., Uematsu, Y., Gismondo, M. R., Murphy, B. R., Rappuoli, R., and Lanzavecchia, A. (2004). An efficient method to make human monoclonal antibodies from memory B cells: potent neutralization of SARS coronavirus. Nat Med 10, 871-875.

Ueda, G., Antanasijevic, A., Fallas, J. A., Sheffler, W., Copps, J., Ellis, D., Hutchinson, G. B., Moyer, A., Yasmeen, A., Tsybovsky, Y., et al. (2020). Tailored design of protein nanoparticle scaffolds for multivalent presentation of viral glycoprotein antigens. Elife 9.

Verkerke, H. P., Williams, J. A., Guttman, M., Simonich, C. A., Liang, Y., Filipavicius, M., Hu, S. L., Overbaugh, J., and Lee, K. K. (2016). Epitope-Independent Purification of Native-Like Envelope Trimers from Diverse HIV-1 Isolates. J Virol 90, 9471-9482.

Walls, A. C., Park, Y. J., Tortorici, M. A., Wall, A., McGuire, A. T., and Veesler, D. (2020). Structure, Function, and Antigenicity of the SARS-COV-2 Spike Glycoprotein. Cell 181, 281-292.e286.

Walls, A. C., Tortorici, M. A., Bosch, B. J., Frenz, B., Rottier, P. J. M., DiMaio, F., Rey, F. A., and Veesler, D. (2016a). Cryo-electron microscopy structure of a coronavirus spike glycoprotein trimer. Nature 531, 114-117.

Walls, A. C., Tortorici, M. A., Frenz, B., Snijder, J., Li, W., Rey, F. A., DiMaio, F., Bosch, B. J., and Veesler, D. (2016b). Glycan shield and epitope masking of a coronavirus spike protein observed by cryo-electron microscopy. Nat Struct Mol Biol 23, 899-905.

Walls, A. C., Tortorici, M. A., Snijder, J., Xiong, X., Bosch, B. J., Rey, F. A., and Veesler, D. (2017). Tectonic conformational changes of a coronavirus spike glycoprotein promote membrane fusion. Proc Natl Acad Sci USA 114, 11157-11162.

Walls, A. C., Xiong, X., Park, Y. J., Tortorici, M. A., Snijder, J., Quispe, J., Cameroni, E., Gopal, R., Dai, M., Lanzavecchia, A., et al. (2019). Unexpected Receptor Functional Mimicry Elucidates Activation of Coronavirus Fusion. Cell 176, 1026-1039.e1015.

Wang, C., Li, W., Drabek, D., Okba, N. M. A., van Haperen, R., Osterhaus, A. D. M. E., van Kuppeveld, F. J. M., Haagmans, B. L., Grosveld, F., and Bosch, B.-J. (2020a). A human monoclonal antibody blocking SARS-COV-2 infection. bioRxiv, 2020.2003.2011.987958.

Wang, Q., Zhang, Y., Wu, L., Niu, S., Song, C., Zhang, Z., Lu, G., Qiao, C., Hu, Y., Yuen, K. Y., et al. (2020b). Structural and Functional Basis of SARS-COV-2 Entry by Using Human ACE2. Cell 181, 894-904.e899.

Watanabe, Y., Allen, J. D., Wrapp, D., Mclellan, J. S., and Crispin, M. (2020). Site-specific glycan analysis of the SARS-COV-2 spike. Science.

Weis, D. D., Engen, J. R., and Kass, I. J. (2006). Semi-automated data processing of hydrogen exchange mass spectra using HX-Express. J Am Soc Mass Spectrom 17, 1700-1703.

Woo, P. C., Lau, S. K., Li, K. S., Poon, R. W., Wong, B. H., Tsoi, H. W., Yip, B. C., Huang, Y., Chan, K. H., and Yuen, K. Y. (2006). Molecular diversity of coronaviruses in bats. Virology 351, 180-187. Wrapp, D., Wang, N., Corbett, K. S., Goldsmith, J. A., Hsieh, C. L., Abiona, O., Graham, B. S., and McLellan, J. S. (2020). Cryo-EM structure of the 2019-nCOV spike in the prefusion conformation. Science 367, 1260-1263.

Wu, Y., Wang, F., Shen, C., Peng, W., Li, D., Zhao, C., Li, Z., Li, S., Bi, Y., Yang, Y., et al. (2020). A noncompeting pair of human neutralizing antibodies block COVID-19 virus binding to its receptor ACE2. Science 368, 1274-1278.

Xiong, X., Qu, K., Ciazynska, K. A., Hosmillo, M., Carter, A. P., Ebrahimi, S., Ke, Z., Scheres, S. H. W., Bergamaschi, L., Grice, G. L., et al. (2020). A thermostable, closed SARS-COV-2 spike protein trimer. Nat Struct Mol Biol.

Xiong, X., Tortorici, M. A., Snijder, J., Yoshioka, C., Walls, A. C., Li, W., McGuire, A. T., Rey, F. A., Bosch, B. J., and Veesler, D. (2018). Glycan Shield and Fusion Activation of a Deltacoronavirus Spike Glycoprotein Fine-Tuned for Enteric Infections. J Virol 92.

Yan, R., Zhang, Y., Li, Y., Xia, L., Guo, Y., and Zhou, Q. (2020). Structural basis for the recognition of SARS-COV-2 by full-length human ACE2. Science 367, 1444-1448.

Yang, Y., Liu, C., Du, L., Jiang, S., Shi, Z., Baric, R. S., and Li, F. (2015). Two Mutations Were Critical for Bat-to-Human Transmission of Middle East Respiratory Syndrome Coronavirus. J Virol 89, 9119-9123.

Yu, J., Tostanoski, L. H., Peter, L., Mercado, N. B., McMahan, K., Mahrokhian, S. H., Nkolola, J. P., Liu, J., Li, Z., Chandrashekar, A., et al. (2020). DNA vaccine protection against SARS-COV-2 in rhesus macaques. Science.

Yuan, M., Wu, N. C., Zhu, X., Lee, C. D., So, R. T. Y., Lv, H., Mok, C. K. P., and Wilson, I. A. (2020). A highly conserved cryptic epitope in the receptor-binding domains of SARS-COV-2 and SARS-COV. Science.

Zhang, Z., Zhang, A., and Xiao, G. (2012). Improved protein hydrogen/deuterium exchange mass spectrometry platform with fully automated data processing. Anal Chem 84, 4942-4949.

Zhou, D., Duyvesteyn, H. M. E., Chen, C. P., Huang, C. G., Chen, T. H., Shih, S. R., Lin, Y. C., Cheng, C. Y., Cheng, S. H., Huang, Y. C., et al. (2020a). Structural basis for the neutralization of SARS-COV-2 by an antibody from a convalescent patient. Nat Struct Mol Biol.

Zhou, H., Chen, X., Hu, T., Li, J., Song, H., Liu, Y., Wang, P., Liu, D., Yang, J., Holmes, E. C., et al. (2020b). A Novel Bat Coronavirus Closely Related to SARS-COV-2 Contains Natural Insertions at the S1/S2 Cleavage Site of the Spike Protein. Curr Biol 30, 2196-2203.e2193.

Zhou, P., Yang, X. L., Wang, X. G., Hu, B., Zhang, L., Zhang, W., Si, H. R., Zhu, Y., Li, B., Huang, C. L., et al. (2020c). A pneumonia outbreak associated with a new coronavirus of probable bat origin. Nature.

Zhu, F. C., Li, Y. H., Guan, X. H., Hou, L. H., Wang, W. J., Li, J. X., Wu, S. P., Wang, B. S., Wang, Z., Wang, L., et al. (2020a). Safety, tolerability, and immunogenicity of a recombinant adenovirus type-5 vectored COVID-19 vaccine: a dose-escalation, open-label, non-randomised, first-in-human trial. Lancet 395, 1845-1854.

Zhu, N., Zhang, D., Wang, W., Li, X., Yang, B., Song, J., Zhao, X., Huang, B., Shi, W., Lu, R., et al. (2020b). A Novel Coronavirus from Patients with Pneumonia in China, 2019. N Engl J Med.

Zost, S. J., Gilchuk, P., Case, J. B., Binshtein, E., Chen, R. E., Nkolola, J. P., Schäfer, A., Reidy, J. X., Trivette, A., Nargi, R. S., et al. (2020). Potently neutralizing and protective human antibodies against SARS-COV-2. Nature.

Methods

TABLE 6

| Resources | | |
|---|---|---|
| REAGENT or RESOURCE | SOURCE | IDENTIFIER |
| Antibodies | | |
| CR3022 | (ter Meulen et al., 2006) | N/A |
| S309 | (Pinto et al., 2020) | N/A |
| B38 | (Wu et al., 2020) | N/A |
| Goat anti-human HRP | Invitrogen | Cat #A18817 Lot #65-180-071919 |
| Goat anti-mouse HRP | Invitrogen | Cat #626520 Lot #TG275230 |
| Horse anti-mouse HRP | Cell Signaling Technology | Cat #7076S |

TABLE 6-continued

| Resources | | |
|---|---|---|
| REAGENT or RESOURCE | SOURCE | IDENTIFIER |
| Anti-mouse Fc Block | BD Biosciences | Cat#553142 RRID: AB_394657 |
| Anti-mouse B220 BUV737 | BD Biosciences | Cat#612838 RRID: AB_2738813 |
| Anti-mouse CD3 PerCP-Cy5.5 | BD Biosciences | Cat#551163 RRID: AB_394082 |
| Anti-mouse CD138 BV650 | BD Biosciences | Cat#564068 RRID: AB_2738574 |
| Anti-mouse CD38 Alexa ™ Fluor 700 | Thermo Fisher Scientific | Cat#56-0381-82 RRID: AB_657740 |
| Anti-mouse GL7 ef450 | Thermo Fisher Scientific | Cat#48-5902-82 RRID: AB_10870775 |
| Anti-mouse IgM BV786 | BD Biosciences | Cat#743328 RRID: AB_2741429 |
| Anti-mouse IgD BUV395 | BD Biosciences | Cat#565988 RRID: AB_2737433 |
| Anti-mouse CD73 PE-Cy7 | Thermo Fisher Scientific | Cat#25-0731-82 RRID: AB_10853348 |
| Anti-mouse CD80 BV605 | BD Biosciences | Cat#563052 RRID: AB_273795 |
| Biological Samples | | |
| BALB/c mice | Jackson Laboratory | Cat #000651 |
| Kymice ™ | Kymab | |
| 20/130 COVID-19 plasma | NIBSC | 20/130 |
| Chemicals, Peptides, and Recombinant Proteins | | |
| AddaVax ™ adjuvant | InvivoGen | Cat# vac-adx-10 |
| ABTS | ThermoFisher | Cat# 37615 |
| TMB | SeraCare | Cat# 5120-0083 |
| Thrombin | Sigma | Cat# T9326-150UN |
| Immobilized Papain | ThermoScientific | Cat# 20341 |
| LysC-endoproteinase | NEB | Cat# P8109S |
| hACE2-Fc | This study | N/A |
| EZ-Link ™ Sulfo-NHS-LC Biotinylation Kit | Thermo Fisher Scientific | Cat#21435 |
| Streptavidin-APC | Agilent | Cat#PJ27S-1 |
| Streptavidin-PE | Agilent | Cat#PJRS25-1 |
| Anti-PE MicroBeads | Miltenyi Biotec | Cat#130-048-801 |
| Anti-APC MicroBeads | Miltenyi Biotec | Cat#130-090-855 |
| DyLight ™ 755 Antibody Labeling Kit | Thermo Fisher Scientific | Cat#84538 |
| AlexaFluor ™ 647 Protein Labeling Kit | Thermo Fisher Scientific | Cat#A20173 |
| Experimental Models: Cell Lines | | |
| Expi 293F | ThermoFisher | Cat #A14527 |
| Vero(C1008)E6 adherent | ECACC General Collection | Cat #85020206 |
| HEK-ACE2 adherent | BEI (Gift from Bloom lab) | NR-52511 |
| HEK293T/17 Adherent | ATCC | Cat# CRL-11268 |
| Vero E6 | ATCC | Cat# CRL-1586 |
| Recombinant DNA | | |
| pCMV-RBD-12GS-50A | GenScript (this study) | N/A |
| pCMVR-RBD-16GS-50A | GenScript (this study) | N/A |
| pCMV-RBD-8GS-50A | GenScript (this study) | N/A |
| S-2P trimer | GenScript (Walls et al. 2020) | BEI NR-52421 |
| RBD | GenScript (Walls et al. 2020) | BEI NR-52422 |
| SARS-CoV-2 S full length | GenScript (Walls et al. 2020) | BEI NR-52420 |
| Murine leukemia virus gag-pol | Millet and Whittaker 2016 | N/A |
| pTG-Luciferase | Millet and Whittaker 2016 | N/A |
| Software and Algorithms | | |
| UCSF ChimeraX | (Goddard et al., 2018) | https://www.rbvi.ucsf.edu/chimerax/ |
| Prism ™ | Graphpad | https://www.graphpad.com/scientific-software/prism/ |
| FlowJo ™ v10 | FlowJo | https://www.flowjo.com |
| Other | | |
| Octet ™ Biosensors: protein A | Sartorius (ForteBio) | Cat# 18-5010 |
| Octet ™ Biosensors: Anti-Penta-HIS (HIS1K) | Sartorius (ForteBio) | Cat# 18-5120 |
| Octet ™ Biosensors: NTA | Sartorius (ForteBio) | Cat# 18-5101 |
| EM supplies 300 mesh grids | Ted Pella | Cat# 01843-F |
| Filter paper | Cytiva | Cat# 1004047 |
| Uranyl formate | SPI Chem | Cat# 02545-AA |
| Unis ™ Capillary Cassettes | Unchained Labs | Cat# 201-1010 |
| PrismA ™ Protein A resin | Cytiva | Cat# 17549802 |
| Superdex ™ 200 Increase SEC column | Cytiva | Cat# 28-9909-44 |
| Superose ™ 6 Increase SEC column | Cytiva | Cat# 29091596 |

TABLE 6-continued

| Resources | | |
|---|---|---|
| REAGENT or RESOURCE | SOURCE | IDENTIFIER |
| Talon ™ resin | TaKaRa | Cat# 635652 |
| VL26 Vantage L column | Millipore | Cat# 96100250 |
| Excel resin | Cytiva | Cat# 17371203 |
| Patterson Veterinary, Isoflurane, USP | Patterson | Cat# 07-893-1389 |
| Eppendorf ® Safe-Lock microcentrifuge tubes 1.5-mL | Sigma Millipore | Cat# T9661 |
| BD Luer-Lok ™ 1-mL Syringe | BD | Cat# BD309628 |
| BD Single Use Needles 25G × ⅞ | VWR | Cat# BD305124 |
| BD PrecisionGlide ™ Needle 23G × 1¼ | BD | Ref# 305120 |
| BD Single Use Needles 27G × 1¼ | VWR | Cat# BD305136 |
| EndoSafe ™ LAL Test Cartridges | Charles River Labs | Cat # PTS20005F |
| Lemo21 ™ (DE3) | New England BioLabs | Cat#C2528J |
| Isopropyl-B-D-thiogalactoside (IPTG) | Sigma Aldrich | Cat#I6758 |
| Kanamycin Sulfate | Sigma-Aldrich | Cat#K1876 |
| HiLoad ™ S200 pg | Cytiva | Cat#28989336 |
| Ni Sepharose ™ 6 FF | Cytiva | Cat#17531808 |
| HisTrap ™ FF | Cytiva | Cat#17525501 |

Cell Lines

HEK293F is a female human embryonic kidney cell line transformed and adapted to grow in suspension (Life Technologies). HEK293F cells were grown in 293FreeStyle™ expression medium (Life Technologies), cultured at 37° C. with 8% $CO_2$ and shaking at 130 rpm. Expi293F™ cells are derived from the HEK293F cell line (Life Technologies). Expi293F™ cells were grown in Expi293™ Expression Medium (Life Technologies), cultured at 36.5° C. with 8% $CO_2$ and shaking at 150 rpm. VeroE6 is a female kidney epithelial cell from African green monkey. HEK293T/17 is a female human embryonic kidney cell line (ATCC). The HEK-ACE2 adherent cell line was obtained through BEI Resources, NIAID, NIH: Human Embryonic Kidney Cells (HEK-293T) Expressing Human Angiotensin-Converting Enzyme 2, HEK-293T-hACE2 Cell Line, NR-52511. All adherent cells were cultured at 37° C. with 8% $CO_2$ in flasks with DMEM+10% FBS (Hyclone)+1% penicillin-streptomycin. Cell lines other than Expi293F were not tested for *mycoplasma* contamination nor authenticated.

Mice

Female BALB/c mice four weeks old were obtained from Jackson Laboratory, Bar Harbor, Maine. Animal procedures were performed under the approvals of the Institutional Animal Care and Use Committee of University of Washington, Seattle, WA, and University of North Carolina, Chapel Hill, NC. Kymab's proprietary IntelliSelect™ Transgenic mouse platform, known as Darwin™, has complete human antibody loci with a non-rearranged human antibody variable and constant germline repertoire. Consequently, the antibodies produced by these mice are fully human.

Pigtail Macaques

Two adult male Pigtail macaques (*Macaca nemestrina*) were immunized in this study. All animals were housed at the Washington National Primate Research Center (WaNPRC), an American Association for the Accreditation of Laboratory Animal Care International (AAALAC)-accredited institution, as previously described (Erasmus et al., 2020). All procedures performed on the animals were with the approval of the University of Washington's Institutional Animal Care and Use Committee (IACUC).

Convalescent Human Sera

Figure 4:
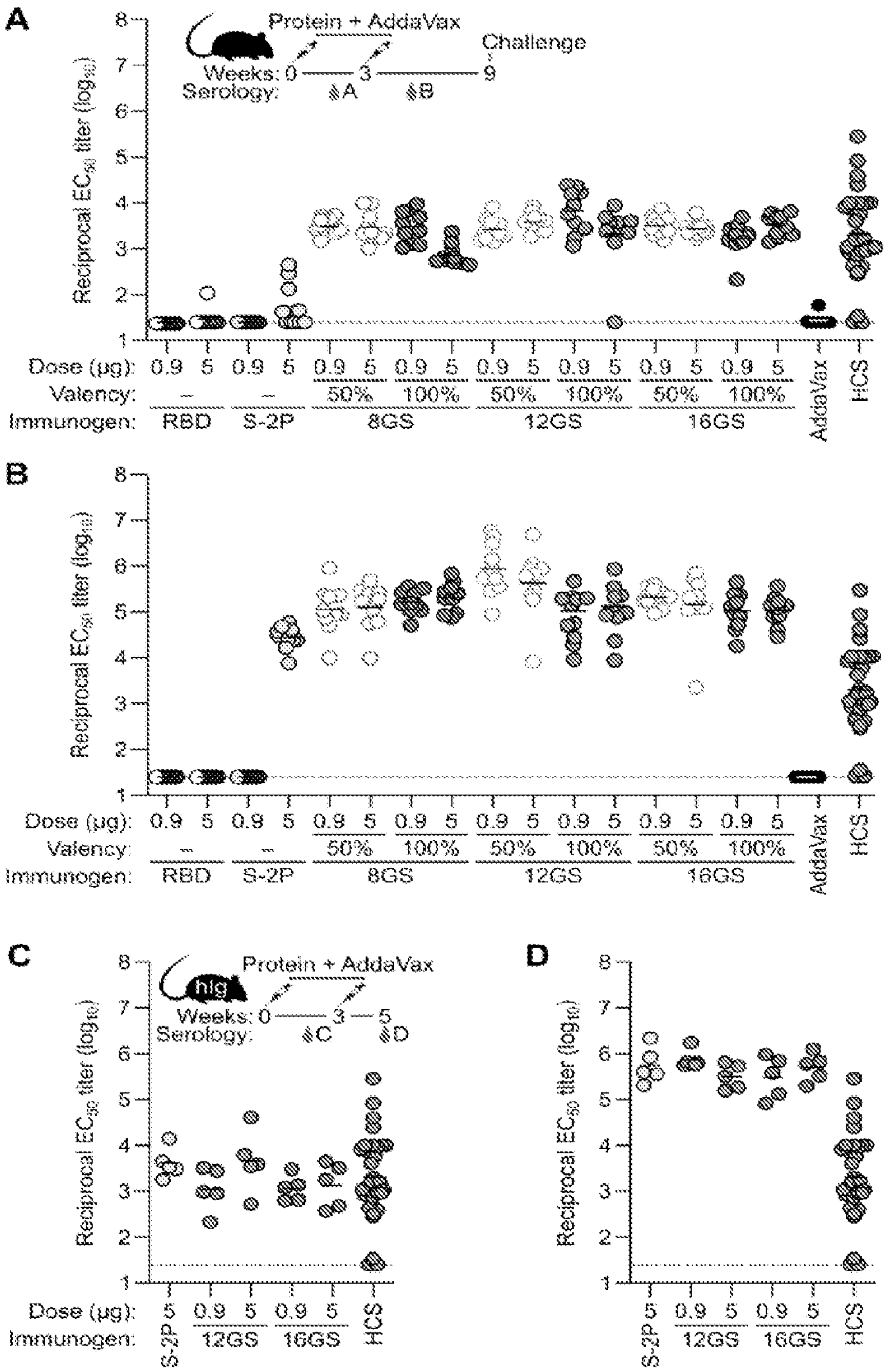
FIG. 4 (A-D). RBD-I53-50 Nanoparticle Immunogens Elicit Potent Antibody Responses in BALB/c and Human Immune Repertoire Mice (A-B) Post-prime (week 2) (A) and post-boost (week 5) (B) anti-S binding titers in BALB/c mice, measured by ELISA. Each symbol represents an individual animal, and the geometric mean from each group is indicated by a horizontal line. The dotted line represents the lower limit of detection of the assay. 8GS, RBD-8GS-I53-50; 12GS, RBD-12GS-I53-50; 16GS, RBD-16GS-I53-50; HCS, human convalescent sera. The inset depicts the study timeline. The immunization experiment was repeated twice and representative data are shown. (C-D) Post-prime (week 2) (C) and post-boost (week 5) (D) anti-S binding titers in Kymab Darwin™ mice, which are transgenic for the non-rearranged human antibody variable and constant region germline repertoire, measured by ELISA and plotted as in (A). The inset depicts the study timeline. The immunization experiment was performed once.
Figure 5:
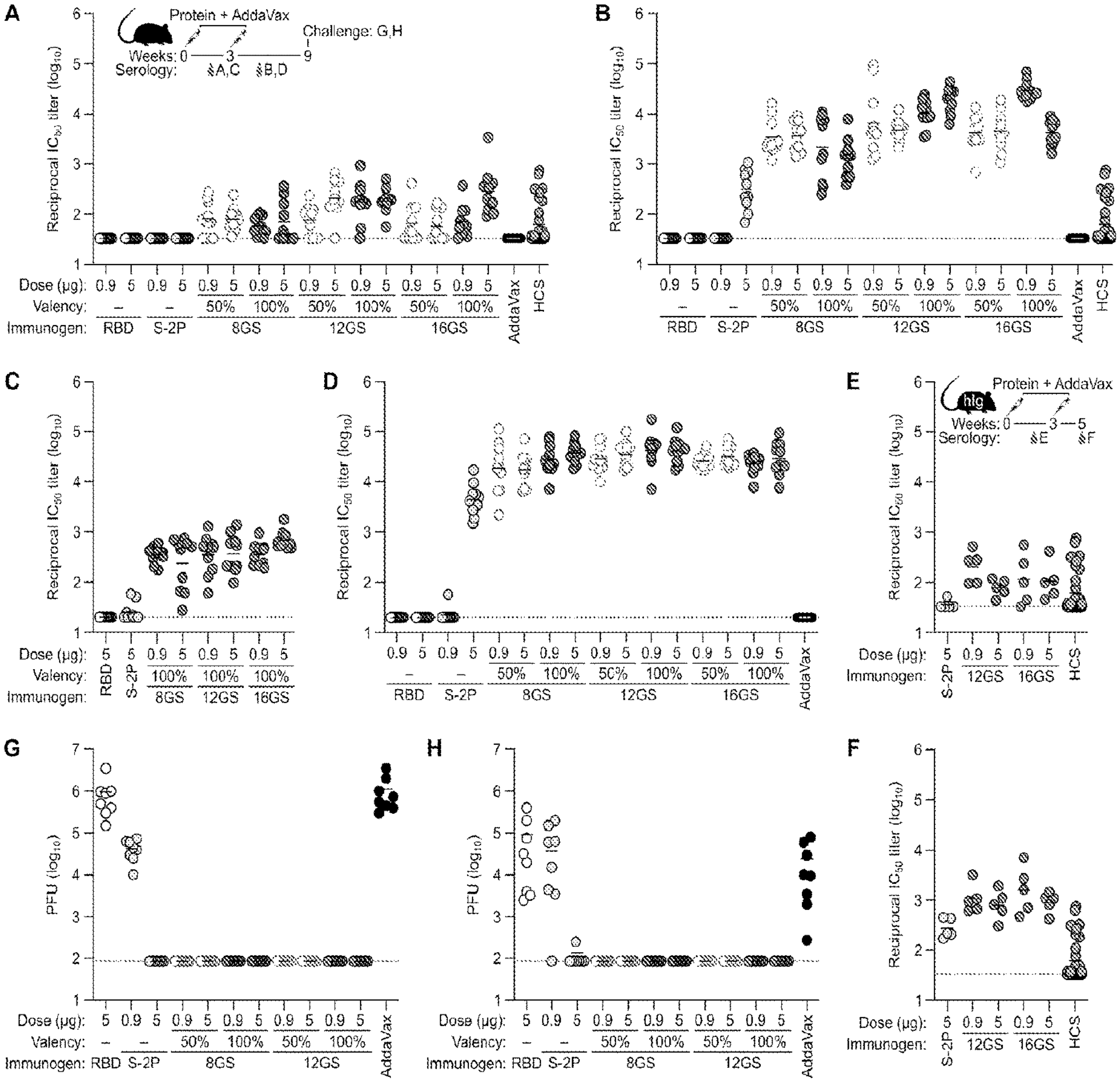
FIG. 5 (A-H). RBD-I53-50 Nanoparticle Immunogens Elicit Potent and Protective Neutralizing Antibody Responses (A-B) Serum pseudovirus neutralizing titers post-prime (A) or post-boost (B) from mice immunized with monomeric RBD, S-2P trimer, or RBD-I53-50 nanoparticles. Each circle represents the reciprocal IC50 of an individual animal. The geometric mean from each group is indicated by a horizontal line. Limit of detection shown as a gray dotted line. The animal experiment was performed twice, and representative data from duplicate measurements are shown. (C-D) Serum live virus neutralizing titers post-prime (C) or post-boost (D) from mice immunized as described in (A). (E-F) Serum pseudovirus neutralizing titers from Kymab Darwin™ mice post-prime (E) and post-boost (F), immunized as described in (A). The animal experiment was performed once, and the neutralization assays were performed at least in duplicate. (G-H) Seven weeks post-boost, eight BALB/c mice per group were challenged with SARS-COV-2 MA. Two days post-challenge, viral titers in lung tissue (G) and nasal turbinates (H) were assessed. Limit of detection depicted as a gray dotted line.
Figure 6:
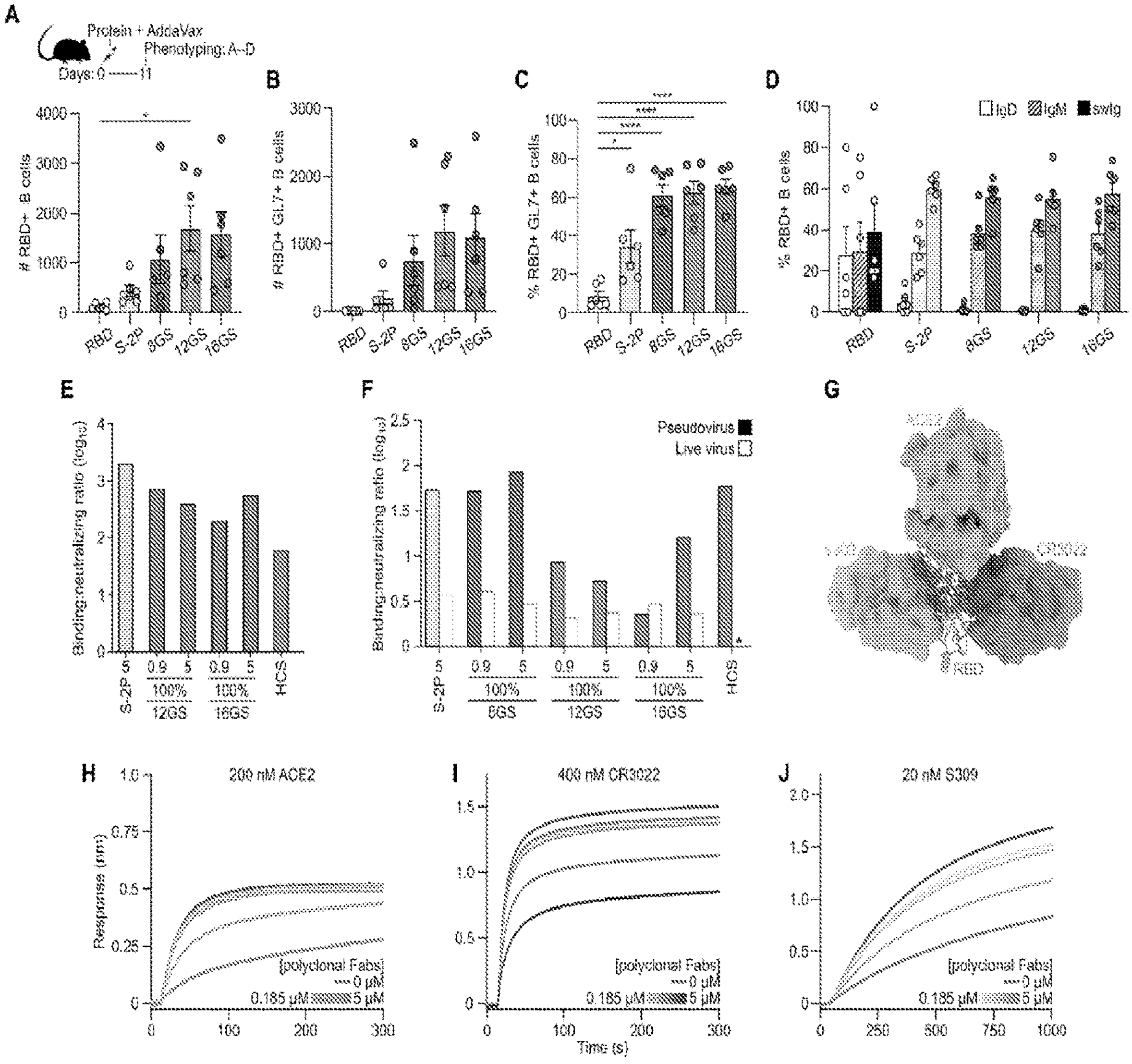
FIG. 6 (A-J). RBD Nanoparticle Vaccines Elicit Robust B Cell Responses and Antibodies Targeting Multiple Epitopes in Mice and a Nonhuman Primate (A-B) Number of (A) RBD+ B cells (B220+CD3−CD138−) and (B) RBD+GC precursors and B cells (CD38+/−GL7+) detected across each immunization group. (C-D) Frequency of (C) RBD+GC precursors and B cells (CD38+/−GL7+) and (D) IgD+, IgM+, or class-switched (IgM−IgD−; swIg+) RBD+GC precursors and B cells. (A-D)N-6 across two experiments for each group. Statistical significance was determined by one-way ANOVA, and Tukey's multiple comparisons tests were performed for any group with a p-value less than 0.05. Significance is indicated with stars: *p<0.05, ****p<0.0001. (E) Ratio post-boost (week 5) of S-2P ELISA binding titer (FIG. 4D) to pseudovirus neutralization titers (FIG. 5F) in Kymab Darwin™ mice. The ratio is the [GMT (EC50) of five mice]: [the GMT (IC50) of five mice] or the EC50:IC50 of all HCS tested. A lower value signifies a higher quality response. (F) Ratio post-boost (week 5) of S-2P ELISA binding titer (FIG. 4B) to either pseudovirus (FIG. 5B) or live virus (FIG. 5D) neutralization titers in BALB/c mice. The ratio is the [GMT (EC50) of ten mice]: [the GMT (IC50) of ten mice] or the EC50:IC50 of all HCS tested. (G) SARS-COV-2 RBD with monomeric ACE2, CR3022 Fab, and S309 Fab bound. (H-J) Determination of vaccine-elicited Ab epitope specificity by competition BLI. A dilution series of polyclonal NHP Fabs was pre-incubated with RBD on the BLI tip. The polyclonal Fab concentration was maintained with the addition of competitor to each dilution point. The 1:3 dilution series of polyclonal Fabs is represented from dark to light, with a dark gray line representing competitor loaded to apo-RBD (no competition). Competition with (H) 200 nM ACE2, (I) 400 nM CR3022, or (J) 20 nM S309.

Samples collected between 1-60 days post infection from 31 individuals who tested positive for SARS-COV-2 by PCR were profiled for anti-SARS-COV-2 S antibody responses and the 29 with anti-S Ab responses were maintained in the cohort (FIGS. 4 and 5). Individuals were enrolled as part of the HAARVI study at the University of Washington in Seattle, WA. Baseline sociodemographic and clinical data for these individuals are summarized in Table 5. This study was approved by the University of Washington Human Subjects Division Institutional Review Board (STUDY00000959 and STUDY00003376). All experiments were performed in at least two technical and two biological replicates (for ELISA and pseudovirus neutralization assays). One sample is the 20/130 COVID-19 plasma from NIBSC.

Plasmid Construction

The SARS-COV-2 RBD (BEI NR-52422) construct was synthesized by GenScript into pcDNA3.1− with an N-terminal mu-phosphatase signal peptide and a C-terminal octa-histidine tag (GHHHHHHHH) (SEQ ID NO:164). The boundaries of the construct are N-$_{328}$RFPN$_{331}$ and $_{528}$KKST$_{531}$-C (Walls et al., 2020). The SARS-COV-2 S-2P ectodomain trimer (GenBank: YP_009724390.1, BEI NR-52420) was synthesized by GenScript into pCMV with an N-terminal mu-phosphatase signal peptide and a C-terminal TEV cleavage site (GSGRENLYFQG) (SEQ ID NO: 165), T4 fibritin foldon (GGGSGYIPEAPRDGQAYVRKDGEWVLLSTFL) (SEQ ID NO:166), and octa-histidine tag (GHHHHHHHH) (SEQ ID NO:164) (Walls et al., 2020). The construct contains the 2P mutations (proline substitutions at residues 986 and 987; (Pallesen et al., 2017)) and an $_{682}$SGAG$_{685}$ substitution at the furin cleavage site. The SARS-COV-2 RBD was genetically fused to the N terminus of the trimeric I53-50A nanoparticle component using linkers of 8, 12, or 16 glycine and serine residues. RBD-8GS- and RBD-12GS-I53-50A fusions were synthesized and cloned by Genscript into pCMV. The RBD-16GS-I53-50A fusion was cloned into pCMV/R using the XbaI and AvrII restriction sites and Gibson assembly (Gibson et al., 2009). All RBD-bearing components contained an N-terminal mu-phosphatase signal peptide and a C-terminal octa-histidine tag. The macaque or human ACE2 ectodomain was genetically fused to a sequence encoding a thrombin cleavage site and a human Fc fragment at the C-terminal end. hACE2-Fc was synthesized and cloned by GenScript with a BM40 signal peptide. Plasmids were transformed into the NEB 5-alpha strain of *E. coli* (New England Biolabs) for subsequent DNA extraction from bacterial culture (NucleoBond Xtra Midi™ kit) to obtain plasmid for transient transfection into Expi293F cells. The amino acid sequences of all novel proteins used in this study can be found in Table 3.

Transient Transfection

SARS-COV-2 S and ACE2-Fc proteins were produced in Expi293F cells grown in suspension using Expi293F expression medium (Life Technologies) at 33° C., 70% humidity, 8% $CO_2$ rotating at 150 rpm. The cultures were transfected using PEI-MAX™ (Polyscience) with cells grown to a density of 3.0 million cells per mL and cultivated for 3 days. Supernatants were clarified by centrifugation (5 minutes at 4000 rcf), addition of PDADMAC solution to a final concentration of 0.0375% (Sigma Aldrich, #409014), and a second spin (5 minutes at 4000 rcf).

Genes encoding CR3022 heavy and light chains were ordered from GenScript and cloned into pCMV/R. Antibodies were expressed by transient co-transfection of both heavy and light chain plasmids in Expi293F cells using PEI MAX™ (Polyscience) transfection reagent. Cell supernatants were harvested and clarified after 3 or 6 days as described above.

Protein Purification

Proteins containing His tags were purified from clarified supernatants via a batch bind method where each clarified supernatant was supplemented with 1 M Tris-HCl pH 8.0 to a final concentration of 45 mM and 5 M NaCl to a final concentration of ~310 mM. Talon cobalt affinity resin (Takara) was added to the treated supernatants and allowed to incubate for 15 minutes with gentle shaking. Resin was collected using vacuum filtration with a 0.2 μm filter and transferred to a gravity column. The resin was washed with 20 mM Tris pH 8.0, 300 mM NaCl, and the protein was eluted with 3 column volumes of 20 mM Tris pH 8.0, 300 mM NaCl, 300 mM imidazole. The batch bind process was then repeated and the first and second elutions combined. SDS-PAGE was used to assess purity. RBD-I53-50A fusion protein IMAC elutions were concentrated to >1 mg/mL and subjected to three rounds of dialysis into 50 mM Tris pH 7, 185 mM NaCl, 100 mM Arginine, 4.5% glycerol, and 0.75% w/v 3-[(3-cholamidopropyl)dimethylammonio]-1-propanesulfonate (CHAPS) in a hydrated 10K molecular weight cutoff dialysis cassette (Thermo Scientific). S-2P IMAC elution fractions were concentrated to ~1 mg/mL and dialyzed three times into 50 mM Tris pH 8, 150 mM NaCl, 0.25% L-Histidine in a hydrated 10K molecular weight cutoff dialysis cassette (Thermo Scientific). Due to inherent instability, the S-2P trimer was immediately flash frozen and stored at −80° C.

Clarified supernatants of cells expressing monoclonal antibodies and human or macaque ACE2-Fc were purified using a MabSelect PrismA™ 2.6×5 cm column (Cytiva) on an AKTA Avant150 FPLC (Cytiva). Bound antibodies were washed with five column volumes of 20 mM $NaPO_4$, 150 mM NaCl pH 7.2, then five column volumes of 20 mM $NaPO_4$, 1 M NaCl pH 7.4 and eluted with three column volumes of 100 mM glycine at pH 3.0. The eluate was neutralized with 2 M Trizma base to 50 mM final concentration. SDS-PAGE was used to assess purity.

Recombinant S309 was expressed as a Fab in expiCHO cells transiently co-transfected with plasmids expressing the heavy and light chain, as described above (see Transient transfection) (Stettler et al., 2016). The protein was affinity-purified using a HiTrap™ Protein A Mab select Xtra™ column (Cytiva) followed by desalting against 20 mM $NaPO_4$, 150 mM NaCl pH 7.2 using a HiTrap™ Fast desalting column (Cytiva). The protein was sterilized with a 0.22 μm filter and stored at 4° C. until use.

Microbial Protein Expression and Purification

The I53-50A and I53-50B.4.PT1 proteins were expressed in Lemo21(DE3)(NEB) in LB (10 g Tryptone, 5 g Yeast Extract, 10 g NaCl) grown in 2 L baffled shake flasks or a 10 L BioFlo 320 Fermenter (Eppendorf). Cells were grown at 37° C. to an OD600 ~0.8, and then induced with 1 mM IPTG. Expression temperature was reduced to 18° C. and the cells shaken for ~16 h. The cells were harvested and lysed by microfluidization using a Microfluidics M110P at 18,000 psi in 50 mM Tris, 500 mM NaCl, 30 mM imidazole, 1 mM PMSF, 0.75% CHAPS. Lysates were clarified by centrifugation at 24,000 g for 30 min and applied to a 2.6×10 cm Ni Sepharose™ 6 FF column (Cytiva) for purification by IMAC on an AKTA Avant150 FPLC system (Cytiva). Protein of interest was eluted over a linear gradient of 30 mM to 500 mM imidazole in a background of 50 mM Tris pH 8, 500 mM NaCl, 0.75% CHAPS buffer. Peak fractions were pooled, concentrated in 10K MWCO centrifugal filters (Millipore), sterile filtered (0.22 μm) and applied to either a Superdex™ 200 Increase 10/300, or HiLoad™ S200 μg GL SEC column (Cytiva) using 50 mM Tris pH 8, 500 mM NaCl, 0.75% CHAPS buffer. I53-50A elutes at ~0.6 column volume (CV). I53-50B.4PT1 elutes at ~0.45 CV. After sizing, bacterial-derived components were tested to confirm low levels of endotoxin before using for nanoparticle assembly.

In Vitro Nanoparticle Assembly

Total protein concentration of purified individual nanoparticle components was determined by measuring absorbance at 280 nm using a UV/vis spectrophotometer (Agilent Cary 8454) and calculated extinction coefficients (Gasteiger et al., 2005). The assembly steps were performed at room temperature with addition in the following order: RBD-I53-50A trimeric fusion protein, followed by additional buffer as needed to achieve desired final concentration, and finally I53-50B.4PT1 pentameric component (in 50 mM Tris pH 8, 500 mM NaCl, 0.75% w/v CHAPS), with a molar ratio of RBD-I53-50A: I53-B.4PT1 of 1.1:1. In order to produce partial valency RBD-I53-50 nanoparticles (50% RBD-I53-50), both RBD-153-50A and unmodified I53-50A trimers (in 50 mM Tris pH 8, 500 mM NaCl, 0.75% w/v CHAPS) were added in a slight molar excess (1.1×) to I53-50B.4PT1. All RBD-I53-50 in vitro assemblies were incubated at 2-8° C. with gentle rocking for at least 30 minutes before subsequent purification by SEC in order to remove residual unassembled component. Different columns were utilized depending on purpose: Superose™ 6 Increase 10/300 GL column was used analytically for nanoparticle size estimation, a Superdex™ 200 Increase 10/300 GL column used for small-scale pilot assemblies, and a HiLoad™ 26/600 Superdex™ 200 μg column used for nanoparticle production. Assembled particles elute at ~11 mL on the Superose™ 6 column and in the void volume of Superdex™ 200 columns. Assembled nanoparticles were sterile filtered (0.22 μm) immediately prior to column application and following pooling of fractions.

hACE2-Fc and CR3022 Digestion hACE2-Fc was digested with thrombin protease (Sigma Aldrich) in the presence of 2.5 mM $CaCl_2$) at a 1:300 w/w thrombin: protein ratio. The reaction was incubated at ambient temperature for 16-18 hours with gentle rocking. Following incubation, the reaction mixture was concentrated using Ultracel™ 10K centrifugal filters (Millipore Amicon Ultra) and sterile filtered (0.22 μM). Cleaved hACE2 monomer was separated from uncleaved hACE2-Fc and the cleaved Fc regions using Protein A purification (see Protein purification above) on a HiScreen MabSelect SuRe™ column (Cytiva) using an ÄKTA avant 25 FPLC (Cytiva). Cleaved hACE2 monomer was collected in the flow through, sterile filtered (0.22 μm), and quantified by UV/vis.

LysC (New England BioLabs) was diluted to 10 ng/μL in 10 mM Tris pH 8 and added to CR3022 IgG at 1:2000 w/w LysC: IgG and subsequently incubated for 18 hours at 37° C. with orbital shaking at 230 rpm. The cleavage reaction was concentrated using Ultracel™ 10K centrifugal filters (Millipore Amicon Ultra) and sterile filtered (0.22 M). Cleaved CR3022 mAb was separated from uncleaved CR3022 IgG and the Fc portion of cleaved IgG, using Protein A purification as described above. Cleaved CR3022 was collected in the flow through, sterile filtered (0.22 μm), and quantified by UV/vis.

Bio-Layer Interferometry (Antigenicity)

Figure 8:
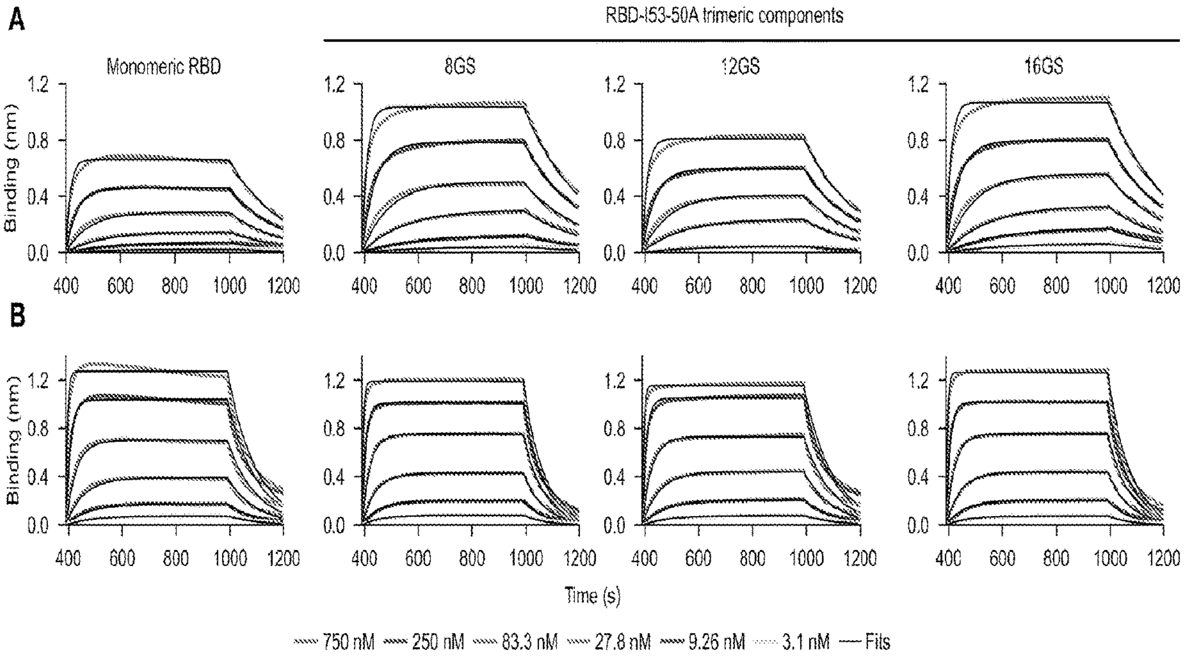
FIG. 8 (A-B). Determination of hACE2 and CR3022 Fab Affinities by Bio-layer Interferometry. (A) Analysis of monomeric hACE2 binding to immobilized monomeric RBD and trimeric RBD-8GS-, RBD-12GS-, and RBD-16GS-I53-50A components. (B) Analysis of CR3022 Fab binding to immobilized monomeric RBD and trimeric RBD-8GS-, RBD-12GS-, and RBD-16GS-I53-50A components. Affinity constants (Table 5) were determined by global fitting of the kinetic data from six analyte concentrations to a 1:1 binding model.

Antigenicity assays were performed and analyzed using BLI on an Octet™ Red 96 System (Pall Forté Bio/Sartorius) at ambient temperature with shaking at 1000 rpm. RBD-153-50A trimeric components and monomeric RBD were diluted to 40 μg/mL in Kinetics buffer (1×HEPES-EP+ (Pall Forté Bio), 0.05% nonfat milk, and 0.02% sodium azide). Monomeric hACE2 and CR3022 Fab were diluted to 750 nM in Kinetics buffer and serially diluted three-fold for a final concentration of 3.1 nM. Reagents were applied to a black 96-well Greiner Bio-one microplate at 200 μL per well as described below. RBD-I53-50A components or monomeric RBD were immobilized onto Anti-Penta-HIS (HIS1K) biosensors per manufacturer instructions (Forte Bio) except using the following sensor incubation times. HIS1K biosensors were hydrated in water for 10 minutes, and were then equilibrated in Kinetics buffer for 60 seconds. The HIS1K tips were loaded with diluted trimeric RBD-I53-50A component or monomeric RBD for 150 seconds and washed with Kinetics buffer for 300 seconds. The association step was performed by dipping the HIS1K biosensors with immobilized immunogen into diluted hACE2 monomer or CR3022 Fab for 600 seconds, then dissociation was measured by inserting the biosensors back into Kinetics buffer for 600 seconds. The data were baseline subtracted and the plots fitted using the Pall™ FortéBio/Sartorius analysis software (version 12.0). Plots in FIG. 8 show the association and dissociation steps.

Bio-Layer Interferometry (Accessibility)

Binding of mACE2-Fc, CR3022 IgG, and S309 IgG to monomeric RBD, RBD-I53-50A trimers, and RBD-I53-50 nanoparticles was analyzed for accessibility experiments and real-time stability studies using an Octet™ Red 96 System (Pall™ FortéBio/Sartorius) at ambient temperature with shaking at 1000 rpm. Protein samples were diluted to 100 nM in Kinetics buffer. Buffer, immunogen, and analyte were then applied to a black 96-well Greiner Bio-one microplate at 200 μL per well. Protein A biosensors (FortéBio/Sartorius) were first hydrated for 10 minutes in Kinetics buffer, then dipped into either mACE2-Fc, CR3022, or S309 IgG diluted to 10 μg/mL in Kinetics buffer in the immobilization step. After 500 seconds, the tips were transferred to Kinetics buffer for 60 seconds to reach a baseline. The association step was performed by dipping the loaded biosensors into the immunogens for 300 seconds, and subsequent dissociation was performed by dipping the biosensors back into Kinetics buffer for an additional 300 seconds. The data were baseline subtracted prior to plotting using the FortéBio analysis software (version 12.0). Plots in FIG. 2 show the 600 seconds of association and dissociation.

Negative Stain Electron Microscopy

RBD-I53-50 nanoparticles were first diluted to 75 μg/mL in 50 mM Tris pH 7, 185 mM NaCl, 100 mM Arginine, 4.5% v/v Glycerol, 0.75% w/v CHAPS, and S-2P protein was diluted to 0.03 mg/mL in 50 mM Tris pH 8, 150 mM NaCl, 0.25% L-Histidine prior to application of 3 μL of sample onto freshly glow-discharged 300-mesh copper grids. Sample was incubated on the grid for 1 minute before the grid was dipped in a 50 μL droplet of water and excess liquid blotted away with filter paper (Whatman). The grids were then dipped into 6 μL of 0.75% w/v uranyl formate stain. Stain was blotted off with filter paper, then the grids were dipped into another 6 μL of stain and incubated for ~70 seconds. Finally, the stain was blotted away and the grids were allowed to dry for 1 minute. Prepared grids were imaged in a Talos model L120C electron microscope at 45,000× (nanoparticles) or 92,000× magnification (S-2P).

Dynamic Light Scattering

Dynamic Light Scattering (DLS) was used to measure hydrodynamic diameter (Dh) and % Polydispersity (% Pd) of RBD-I53-50 nanoparticle samples on an UNcle Nano-DSF (UNchained Laboratories). Sample was applied to a 8.8 μL quartz capillary cassette (UNi, UNchained Laboratories) and measured with 10 acquisitions of 5 seconds each, using auto-attenuation of the laser. Increased viscosity due to 4.5% v/v glycerol in the RBD nanoparticle buffer was accounted for by the UNcle™ Client software in Dh measurements.

Guanidine HCl Denaturation

Monomeric RBD, RBD-I53-50A fusion proteins, and RBD-I53-50 nanoparticle immunogens were diluted to 2.5 μM in 50 mM Tris pH 7.0, 185 mM NaCl, 100 mM Arginine, 4.5% v/v glycerol, 0.75% w/v CHAPS, and guanidine chloride [GdnHCl] ranging from 0 M to 6.5 M, increasing in 0.25 M increments, and prepared in triplicate. S-2P trimer was also diluted to 2.5 μM using 50 mM Tris pH 8, 150 mM NaCl, 0.25% L-Histidine, and the same GuHCl concentration range. Dilutions were mixed 10× by pipetting. The samples were then incubated 18-19 hours at ambient temperature. Using a Nano-DSF (UNcle™, UNchained Laboratories) and an 8.8 μL quartz capillary cassette (UNi™, UNchained Laboratories), fluorescence spectra were collected in triplicate, exciting at 266 nm and measuring emission from 200 nm to 750 nm at 25° C.

Endotoxin Measurements

Endotoxin levels in protein samples were measured using the EndoSafe™ Nexgen-MCS System (Charles River). Samples were diluted 1:50 or 1:100 in Endotoxin-free LAL reagent water, and applied into wells of an EndoSafe™ LAL reagent cartridge. Charles River EndoScan™-V software was used to analyze endotoxin content, automatically back-calculating for the dilution factor. Endotoxin values were reported as EU/mL which were then converted to EU/mg based on UV/vis measurements. Our threshold for samples suitable for immunization was <50 EU/mg.

UV/Vis

Ultraviolet-visible spectrophotometry (UV/vis) was measured using an Agilent Technologies Cary™ 8454. Samples were applied to a 10 mm, 50 μL quartz cell (Starna Cells, Inc.) and absorbance was measured from 180 to 1000 nm.

Net absorbance at 280 nm, obtained from measurement and single reference wavelength baseline subtraction, was used with calculated extinction coefficients and molecular weights to obtain protein concentration. The ratio of absorbance at 320/280 nm was used to determine relative aggregation levels in real-time stability study samples. Samples were diluted with respective purification/instrument blanking buffers to obtain an absorbance between 0.1 and 1.0. All data produced from the UV/vis instrument was processed in the 845×UV/visible System software.

Glycan Profiling

To identify site-specific glycosylation profiles, including glycoform distribution and occupancy determination, a bottom up mass spectrometry (MS) approach was utilized. Aliquots of 1 mg/mL monomeric, 8GS, 12GS and 16GS RBD protein were prepared to evaluate the glycosylation profiles at N331 and N343 of the four RBD variants. Comprehensive glycoprofiling on the stabilized Spike ectodomain (S-2P) was performed in parallel using 1.5 mg/mL SARS-COV-2 S-2P protein. All the samples were denatured in a solution containing 25 mM Tris (pH 8.0), 7 M guanidinium chloride (GdnHCl) and 50 mM dithiothreitol (DTT) at 90° C. for 30 minutes. Reduced cysteines were alkylated by adding fresh iodoacetamide (IAA) to 100 mM and incubating at room temperature for 1 hour in the dark. 50 mM excess DTT was then added to quench the remaining IAA. The GndHCl concentration was reduced to 0.6 M by diluting the samples 11-fold with a 10 mM Tris (pH 8.0), 2 mM calcium chloride solution. Each sample was then split in half. One half (275 μL) was mixed with 10 units of recombinant Peptide N-glycanase F (GST-PNGase F) (Krenkova et al., 2013) and incubated at 37° C. for 1 hour in order to convert glycosylated Asn into deglycosylated Asp.

Protease digestions were performed in the following manner: all RBD samples and one S-2P sample were digested with Lys-C at a ratio of 1:40 (w/w) for RBD and 1:30 (w/w) for S-2P for 4 hours at 37° C., followed by Glu-C digestion overnight at the same ratios and conditions. The other three S-2P samples were digested with trypsin, chymotrypsin and alpha lytic protease, respectively, at a ratio of 1:30 (w/w) overnight at 37° C. All the digestion proteases used were MS grade (Promega). The next day, the digestion reactions were quenched by 0.02% formic acid (FA, Optima™, Fisher).

The glycoform determination of four S-2P samples was performed by nano LC-MS using an Orbitrap Fusion™ mass spectrometer (Thermo Fisher). The digested samples were desalted by Sep-Pak C18 cartridges (Waters) following the manufacturer's suggested protocol. A 2 cm trapping column and a 35 cm analytical column were freshly prepared in fused silica (100 μm ID) with 5 μM ReproSil-Pur™ C18 AQ beads (Dr. Maisch). 8 μL sample was injected and run by a 60-minute linear gradient from 2% to 30% acetonitrile in 0.1% FA, followed by 10 minutes of 80% acetonitrile. An EThcD method was optimized as followed: ion source: 2.1 kV for positive mode; ion transfer tube temperature: 350° C.; resolution: $MS^1$=120000, $MS^2$=30000; AGC target: $MS^1$=2$e^5$, $MS^2$=1$e^5$; and injection time: $MS^1$=50 ms, $MS^2$=60 ms.

Glycopeptide data were visualized and processed by Byonic™ and Byologic™ (Version 3.8, Protein Metrics Inc.) using a 6 ppm precursor and 10 ppm fragment mass tolerance. Glycopeptides were searched using the N-glycan 309 mammalian database in Protein Metrics PMI-Suite and scored based on the assignment of correct c- and z-fragment ions. The true-positive entities were further validated by the presence of glycan oxonium ions m/z at 204 (HexNAc ions) and 366 (HexNAcHex ions) and the absence in its corresponding spectrum in the deglycosylated sample. The relative abundance of each glycoform was determined by the peak area analyzed in Byologic™. Glycoforms were categorized in Oligo (Oligomannose), Hybrid, and Complex as well as subtypes in Complex, described in the previous study (Watanabe et al., 2020). HexNAc (2) Hex (9-5) is M(annose)9 to M5; HexNAc(3)Hex(5-6) is classified as Hybrid; HexNAc(3)Hex(3-4)X is A1 subtype; HexNAc(4)X is A2/A1B; HexNAc(5)X is A3/A2B and HexNAc(6)X is A4/A3B subtype. Hybrid and Complex forms with fucosylation are separately listed as FHybrid and FComplex (eg. FA1), respectively.

Glycan occupancy analysis and glycoform determination of the four RBD variants were performed by LC-MS on the Synapt G2-Si™ TOF mass spectrometer coupled to an Acquity™ UPLC system (Waters). Samples were resolved over a Waters CSH C18 1×100 mm 1.7 μm column with a linear gradient from 3% to 40% B over 30 minutes (A: 98% water, 2% acetonitrile, 0.1% FA; B: 100% acetonitrile, 0.1% FA). Data dependent acquisition (DDA) method was utilized with precursor mass range 300-2000, MS/MS mass range 50-2000 and a collision energy ramped from 70 to 100 V. Chromatographic peaks for the most abundant and non-overlapped isotopic peaks were determined and integrated with MassLynx™ (Waters). All the water and organic solvents used, unless specifically stated, were MS grade (Optima™, Fisher). The peak area ratio of the non-glycosylated (Asn) to the deglycosylated (Asp) glycopeptide was used to measure the glycan occupancy at each site.

Hydrogen/Deuterium-Exchange Mass Spectrometry

3 μg of monomeric RBD and RBD-8GS-I53-50A were incubated and H/D exchanged (HDX) in the deuteration buffer (pH* 7.6, 85% D20, Cambridge Isotope Laboratories, Inc.) for 3, 60, 1800, and 72000 seconds, respectively, at 23° C. Samples were subsequently mixed 1:1 with ice-cold quench buffer (200 mM tris(2-chlorethyl) phosphate (TCEP), 8 M Urea, 0.2% formic acid) for a final pH 2.5 and immediately flash frozen in liquid nitrogen. Samples were in-line pepsin digested and analyzed by LC-MS-IMS on Synapt G2-Si™ TOF mass spectrometer (Waters) as previously described (Verkerke et al., 2016) with an 18 minute gradient applied. A fully deuteration control was made by collecting the pepsin digest eluate from an undeuterated sample LC-MS run, drying by speedvac, incubating in deuteration buffer for 1 hour at 85° C., and quenching the same as all other HDX samples. Internal exchange standards (Pro-Pro-Pro-Ile [PPPI] and Pro-Pro-Pro-Phe [PPPF]) were added in each sample to ensure consistent labeling conditions for all samples (Zhang et al., 2012). Pepsin digests for undeuterated samples were also analyzed by nano LC-MS using an Orbitrap Fusion™ mass spectrometer (Thermo Fisher) with the settings as described above for glycoprofiling. The data was then processed by Byonic™ to obtain the peptide reference list. Peptides were manually validated using DriftScope™ (Waters) and identified with orthogonal retention time (rt) and drift time (dt) coordinates. Deuterium uptake analysis was performed with HX-Express v2 (Guttman et al., 2013; Weis et al., 2006). Peaks were identified from the peptide spectra with binomial fitting applied. The deuterium uptake level was normalized relative to fully deuterated standards.

Mouse Immunizations and Challenge

Female BALB/c (Stock: 000651) mice were purchased at the age of four weeks from The Jackson Laboratory, Bar Harbor, Maine, and maintained at the Comparative Medicine Facility at the University of Washington, Seattle, WA, accredited by the American Association for the Accreditation of Laboratory Animal Care International (AAALAC). At six weeks of age, 10 mice per dosing group were vaccinated with a prime immunization, and three weeks later mice were boosted with a second vaccination. Prior to inoculation, immunogen suspensions were gently mixed 1:1 vol/vol with AddaVax™ adjuvant (Invivogen, San Diego, CA) to reach a final concentration of 0.009 or 0.05 mg/mL antigen. Mice were injected intramuscularly into the gastrocnemius muscle of each hind leg using a 27-gauge needle (BD, San Diego, CA) with 50 μL per injection site (100 μL total) of immunogen under isoflurane anesthesia. To obtain sera all mice were bled two weeks after prime and boost immunizations. Blood was collected via submental venous puncture and rested in 1.5 mL plastic Eppendorf tubes at room temperature for 30 minutes to allow for coagulation. Serum was separated from hematocrit via centrifugation at 2000 g for 10 minutes. Complement factors and pathogens in isolated serum were heat-inactivated via incubating serum at 56° C. for 60 minutes. Serum was stored at 4° C. or −80° C. until use. Six weeks post-boost, mice were exported from Comparative Medicine Facility at the University of Washington, Seattle, WA to an AAALAC accredited Animal Biosafety Level 3 (ABSL3) Laboratory at the University of North Carolina, Chapel Hill. After a 7-day acclimation time, mice were anesthetized with a mixture of ketamine/xylazine and challenged intranasally with $10^5$ plaque-forming units (pfu) of mouse-adapted SARS-COV-2 MA strain for the evaluation of vaccine efficacy (IACUC protocol 20-114.0). After infection, body weight was monitored daily until the termination of the study two days post-infection, when lung and nasal turbinate tissues were harvested to evaluate the viral load by plaque assay. All experiments were conducted at the University of Washington, Seattle, WA, and University of North Carolina, Chapel Hill, NC according to approved Institutional Animal Care and Use Committee protocols.

Immunization (Kymab Darwin™ Mice)

Kymab Darwin™ mice (a mix of males and females, 10 weeks of age), 5 mice per dosing group, were vaccinated with a prime immunization and three weeks later boosted with a second vaccination. Prior to inoculation, immunogen suspensions were gently mixed 1:1 vol/vol with AddaVax™ adjuvant (Invivogen) to reach a final concentration of 0.009 or 0.05 mg/mL antigen. Mice were injected intramuscularly into the tibialis muscle of each hind leg using a 30-gauge needle (BD) with 20 μL per injection site (40 μL total) of immunogen under isoflurane anesthesia. A final boost was administered intravenously (50 μL) with no adjuvant at week 7. Mice were sacrificed 5 days later under UK Home Office Schedule 1 (rising concentration of $CO_2$) and spleen, lymph nodes, and bone marrow cryopreserved. Whole blood (0.1 ml) was collected 2 weeks after each dose (weeks 0, 2, 5, and week 8 terminal bleed). Serum was separated from hematocrit via centrifugation at 2000 g for 10 minutes. Serum was stored at −20° C. and was used to monitor titers by ELISA. All mice were maintained and all procedures carried out under United Kingdom Home Office License 70/8718 and with the approval of the Wellcome Trust Sanger Institute Animal Welfare and Ethical Review Body.

ELISA

For anti-S-2P ELISA, 25 μL of 2 μg/mL S-2P was plated onto 384-well Nunc Maxisorp™ (ThermoFisher) plates in PBS and sealed overnight at 4° C. The next day plates were washed 4× in Tris Buffered Saline Tween (TBST) using a plate washer (BioTek) and blocked with 2% BSA in TBST for 1 h at 37° C. Plates were washed 4× in TBST and 1:5 serial dilutions of mouse, NHP, or human sera were made in 25 μL TBST starting at 1:25 or 1:50 and incubated at 37° C. for 1 h. Plates were washed 4× in TBST, then anti-mouse (Invitrogen) or anti-human (Invitrogen) horseradish peroxidase-conjugated antibodies were diluted 1:5,000 and 25 μL added to each well and incubated at 37° C. for 1 h. Plates were washed 4× in TBST and 25 μL of TMB (SeraCare) was added to every well for 5 min at room temperature. The reaction was quenched with the addition of 25 μL of 1N HCl. Plates were immediately read at 450 nm on a VarioSkanLux™ plate reader (ThermoFisher) and data plotted and fit in Prism™ (GraphPad) using nonlinear regression sigmoidal, 4PL, X is log (concentration) to determine $EC_{50}$ values from curve fits.

Pseudovirus Production

MLV-based SARS-COV-2 S, SARS-COV S, and WIV-1 pseudotypes were prepared as previously described (Millet and Whittaker, 2016; Walls et al., 2020). Briefly, HEK293T cells were co-transfected using Lipofectamine™ 2000 (Life Technologies) with an S-encoding plasmid, an MLV Gag-Pol packaging construct, and the MLV transfer vector encoding a luciferase reporter according to the manufacturer's instructions. Cells were washed 3× with Opti-MEM and incubated for 5 h at 37° C. with transfection medium. DMEM containing 10% FBS was added for 60 h. The supernatants were harvested by a 2,500 g spin, filtered through a 0.45 μm filter, concentrated with a 100 kDa membrane for 10 min at 2,500 g and then aliquoted and placed at −80° C.

Pseudovirus Entry and Serum Neutralization Assays

HEK-hACE2 cells were cultured in DMEM with 10% FBS (Hyclone) and 1% PenStrep with 8% $CO_2$ in a 37° C. incubator (ThermoFisher). One day prior to infection, 40 μL of poly-lysine (Sigma) was placed into 96-well plates and incubated with rotation for 5 min. Poly-lysine was removed, plates were dried for 5 min then washed 1× with DMEM prior to plating cells. The following day, cells were checked to be at 80% confluence. In a half-area 96-well plate a 1:3 serial dilution of sera was made in DMEM starting between 1:3 and 1:66 initial dilution in 22 μL final volume. 22 μL of pseudovirus was then added to the serial dilution and incubated at room temperature for 30-60 min. HEK-hACE2 plate media was removed and 40 μL of the sera/virus mixture was added to the cells and incubated for 2 h at 37° C. with 8% $CO_2$. Following incubation, 40 μL 20% FBS and 2% PenStrep containing DMEM was added to the cells for 48 h. Following the 48-h infection, One-Glo-EX™ (Promega) was added to the cells in half culturing volume (40 μL added) and incubated in the dark for 5 min prior to reading on a Varioskan™ LUX plate reader (ThermoFisher). Measurements were done on all ten mouse sera samples from each group in at least duplicate. Relative luciferase units were plotted and normalized in Prism™ (GraphPad) using a zero value of cells alone and a 100% value of 1:2 virus alone. Nonlinear regression of log (inhibitor) vs. normalized response was used to determine IC50 values from curve fits. Mann-Whitney tests were used to compare two groups to determine whether they were statistically different.

Live Virus Production

SARS-COV-2-nanoLuc virus (WA1 strain) in which ORF7 was replaced by nanoluciferase gene (nanoLuc), and mouse-adapted SARS-COV-2 (SARS-COV-2 MA) (Dinnon et al., 2020) were generated by the coronavirus reverse genetics system described previously (Hou et al., 2020). Recombinant viruses were generated in Vero E6 cells (ATCC-CRL1586) grown in DMEM high glucose media (Gibco #11995065) supplemented with 10% Hyclone™

Fetal Clone II (GE #SH3006603HI), 1% non-essential amino acid, and 1% Pen/Strep in a 37° C.+5% $CO_2$ incubator. To generate recombinant SARS-COV-2, seven DNA fragments which collectively encode the full-length genome of SARS-COV-2 flanked by a 5' T7 promoter and a 3' poly A tail were ligated and transcribed in vitro. The transcribed RNA was electroporated into Vero E6 cells to generate a PO virus stock. The seed virus was amplified twice in Vero E6 cells at low moi for 48 h to create a working stock which was titered by plaque assay (Hou et al., 2020). All the live virus experiments, including the ligation and electroporation steps, were performed under biosafety level 3 (BSL-3) conditions at negative pressure, by operators in Tyvek suits wearing personal powered-air purifying respirators.

Luciferase-Based Serum Neutralization Assay, SARS-COV-2-nanoLuc

Vero E6 cells were seeded at $2\times10^4$ cells/well in a 96-well plate 24 h before the assay. One hundred pfu of SARS-COV-2-nanoLuc virus (Hou et al., 2020) were mixed with serum at 1:1 ratio and incubated at 37° C. for 1 h. An 8-point, 3-fold dilution curve was generated for each sample with starting concentration at 1:20 (standard) or 1:2000 (high neutralizer). Virus and serum mix was added to each well and incubated at 37° C.+5% $CO_2$ for 48 h. Luciferase activities were measured by Nano-Glo™ Luciferase Assay System (Promega, WI) following manufacturer protocol using SpectraMax™ M3 luminometer (Molecular Device). Percent inhibition and 50% inhibition concentration (IC50) were calculated by the following equation: [1−(RLU with sample/RLU with mock treatment)]×100%. Fifty percent inhibition titer (IC50) was calculated in GraphPad Prism™ 8.3.0 by fitting the data points using a sigmoidal dose-response (variable slope) curve.

Tetramer Production

Recombinant SARS-COV-2 S-2P trimer was biotinylated using the EZ-Link™ Sulfo-NHS-LC Biotinylation Kit (ThermoFisher) and tetramerized with streptavidin-APC (Agilent) as previously described (Krishnamurty et al., 2016; Taylor et al., 2012). The RBD domain of SARS-COV-2 S was biotinylated and tetramerized with streptavidin-APC (Agilent). The APC decoy reagent was generated by conjugating SA-APC to Dylight™ 755 using a DyLight 755 antibody labeling kit (ThermoFisher), washing and removing unbound DyLight 755, and incubating with excess of an irrelevant biotinylated His-tagged protein. The PE decoy was generated in the same manner, by conjugating SA-PE to Alexa Fluor 647 with an AF647 antibody labeling kit (ThermoFisher).

Mouse Immunization, Cell Enrichment, and Flow Cytometry

For phenotyping of B cells, 6-week old female BALB/c mice, three per dosing group, were immunized intramuscularly with 50 µL per injection site of vaccine formulations containing 5 µg of SARS-COV-2 antigen (either S-2P trimer or RBD, but not including mass from the I53-50 nanoparticle) mixed 1:1 vol/vol with AddaVax™ adjuvant on day 0. All experimental mice were euthanized for harvesting of inguinal and popliteal lymph nodes on day 11. The experiment was repeated two times. Popliteal and inguinal lymph nodes were collected and pooled for individual mice. Cell suspensions were prepared by mashing lymph nodes and filtering through 100 µM Nitex™ mesh. Cells were resuspended in PBS containing 2% FBS and Fc block (2.4G2), and were incubated with 10 nM Decoy tetramers at room temperature for 20 min. RBD-PE tetramer and Spike-APC tetramer were added at a concentration of 10 nM and incubated on ice for 20 min. Cells were washed, incubated with anti-PE and anti-APC magnetic beads on ice for 30 min, then passed over magnetized LS columns (Miltenyi Biotec). Bound B cells were stained with anti-mouse B220 (BUV737), CD3 (PerCP-Cy5.5), CD138 (BV650), CD38 (Alexa Fluor™ 700), GL7 (eFluor™ 450), IgM (BV786), IgD (BUV395), CD73 (PE-Cy7), and CD80 (BV605) on ice for 20 min. Cells were run on the Cytek Aurora™ and analyzed using FlowJo™ software (Treestar). Cell counts were determined using Accucheck™ cell counting beads.

NHP Immunization

A Pigtail macaque was immunized with 250 µg of RBD-12GS-I53-50 nanoparticle (88 µg RBD antigen) at day 0 and day 28. Blood was collected at days 0, 10, 14, 28, 42, and 56 days post-prime. Serum and plasma were collected as previously described (Erasmus et al., 2020). Prior to vaccination or blood collection, animals were sedated with an intramuscular injection (10 mg/kg) of ketamine (Ketaset®; Henry Schein). Prior to inoculation, immunogen suspensions were gently mixed 1:1 vol/vol with AddaVax™ adjuvant (Invivogen, San Diego, CA) to reach a final concentration of 0.250 mg/mL antigen. The vaccine was delivered intramuscularly into both quadriceps muscles with 1 mL per injection site on days 0 and 28. All injection sites were shaved prior to injection and monitored post-injection for any signs of local reactogenicity. At each study timepoint, full physical exams and evaluation of general health were performed on the animals, as previously described (Erasmus et al., 2020), and no adverse events were observed.

Competition Bio-Layer Interferometry

Purification of Fabs from NHP serum was adapted from (Boyoglu-Barnum et al., 2020). Briefly, 1 mL of day 56 serum was diluted to 10 mL with PBS and incubated with 1 mL of 3×PBS washed protein A beads (GenScript) with agitation overnight at 37° C. The next day beads were thoroughly washed with PBS using a gravity flow column and bound antibodies were eluted with 0.1 M glycine pH 3.5 into 1M Tris-HCl (pH 8.0) to a final concentration of 100 mM. Serum and early washes that flowed through were re-bound to beads overnight again for a second, repeat elution. IgGs were concentrated (Amicon 30 kDa) and buffer exchanged into PBS. 2× digestion buffer (40 mM sodium phosphate pH 6.5, 20 mM EDTA, 40 mM cysteine) was added to concentrated and pooled IgGs. 500 µL of resuspended immobilized papain resin (ThermoFisher Scientific) freshly washed in 1× digestion buffer (20 mM sodium phosphate, 10 mM EDTA, 20 mM cysteine, pH 6.5) was added to purified IgGs in 2× digestion buffer and samples were agitated for 5 h at 37° C. The supernatant was separated from resin and resin washes were collected and pooled with the resin flow through. Pooled supernatants were sterile-filtered at 0.22 µm and applied 6× to PBS-washed protein A beads in a gravity flow column. The column was eluted as described above and the papain procedure repeated overnight with undigested IgGs to increase yield. The protein A flowthroughs were pooled, concentrated (Amicon 10 kDa), and buffer exchanged into PBS. Purity was checked by SDS-PAGE.

Epitope competition was performed and analyzed using BLI on an Octet™ Red 96 System (Pall™ Forté Bio/Sartorius) at 30° C. with shaking at 1000 rpm. NTA biosensors (Pall™ Forté Bio/Sartorius) were hydrated in water for at least 10 minutes, and were then equilibrated in 10× Kinetics buffer (KB) (Pall™ Forté Bio/Sartorius) for 60 seconds. 10 ng/µL monomeric RBD in 10× KB was loaded for 100 seconds prior to baseline acquisition in 10×KB for 300 seconds. Tips were then dipped into diluted polyclonal Fab in 10× KB in a 1:3 serial dilution beginning with 5000 nM for 2000 seconds or maintained in 10×KB. Tips bound at varying levels depending on the polyclonal Fab concentration. Tips were then dipped into the same concentration of polyclonal Fab plus either 200 nM of hACE2, 400 nM CR3022, or 20 nM S309 and incubated for 300-2000 seconds. The data were baseline subtracted and aligned to pre-loading with polyclonal Fabs using the Pall™ Forte Bio/Sartorius analysis software (version 12.0) and plotted in PRISM™.

5. The nanoparticle of claim 2, wherein the first proteins comprise the amino acid sequence of SEQ ID NO:155.

6. The nanoparticle of claim 2, wherein each first assembly is pentameric and each second assembly is trimeric.

7. The nanoparticle of claim 2, wherein:

(a) the first proteins comprise the amino acid sequence of SEQ ID NO: 155;

SEQUENCE LISTING (193 sequences)

SEQ ID NO: 1 - protein, 435 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 2 - protein, 463 aa, Artificial Sequence
  Synthetic
  MISC_FEATURE (1)..(28): optionally absent
  MISC_FEATURE (223)..(260): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 3 - protein, 408 aa, Artificial Sequence
  Synthetic
  MISC_FEATURE (204)..(205): optional any amino acid
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 4 - protein, 440 aa, Artificial Sequence
  Synthetic
  MISC_FEATURE (1)..(32): optionally absent
  MISC_FEATURE (236)..(237): optional any amino acid
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 5 - protein, 439 aa, Artificial Sequence
  Synthetic
  MISC_FEATURE (209)..(235): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 6 - protein, 467 aa, Artificial Sequence
  Synthetic
  MISC_FEATURE (1)..(32): optionally absent
  MISC_FEATURE (237)..(263): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 7 - protein, 412 aa, Artificial Sequence
  Synthetic
  MISC_FEATURE (208)..(209): optional any amino acid
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 8 - protein, 467 aa, Artificial Sequence; identical to SEQ ID NO: 6
  Synthetic
  MISC_FEATURE (1)..(32): optionally absent
  MISC_FEATURE (237)..(263): optionally absent

SEQ ID NO: 9 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 10 - protein, 450 aa, Artificial Sequence
  Synthetic
  MISC_FEATURE (209)..(235): optionally absent
  MISC_FEATURE (440)..(450): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 11 - protein, 451 aa, Artificial Sequence
  Synthetic
  MISC_FEATURE (1)..(32): optionally absent
  MISC_FEATURE (236)..(237): optional any amino acid
  MISC_FEATURE (441)..(451): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 12 - protein, 423 aa, Artificial Sequence
  Synthetic
  MISC_FEATURE (208)..(209): optional any amino acid
  MISC_FEATURE (413)..(423): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 13 - protein, 427 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 14 - protein, 470 aa, Artificial Sequence
  Synthetic
  MISC_FEATURE (1)..(32): optionally absent
  MISC_FEATURE (460)..(470): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 15 - protein, 431 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 16 - protein, 442 aa, Artificial Sequence
  Synthetic
  MISC_FEATURE (432)..(442): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 17 - protein, 408 aa, Artificial Sequence; identical to SEQ ID NO: 3
  Synthetic

SEQ ID NO: 18 - protein, 451 aa, Artificial Sequence; identical to SEQ ID NO: 11
  Synthetic
  MISC_FEATURE (1)..(32): optionally absent
  MISC_FEATURE (236)..(237): optional any amino acid
  MISC_FEATURE (441)..(451): optionally absent

SEQ ID NO: 19 - protein, 412 aa, Artificial Sequence; identical to SEQ ID NO: 7
  Synthetic
  MISC_FEATURE (208)..(209): optional any amino acid

SEQ ID NO: 20 - protein, 423 aa, Artificial Sequence; identical to SEQ ID NO: 12
  Synthetic
  MISC_FEATURE (208)..(209): optional any amino acid
  MISC_FEATURE (413)..(423): optionally absent

SEQ ID NO: 21 - protein, 430 aa, Artificial Sequence
  Synthetic
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 22 - protein, 474 aa, Artificial Sequence
  Synthetic
  MISC_FEATURE (1)..(32): optionally absent
  MISC_FEATURE (464)..(474): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 23 - protein, 435 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 24 - protein, 446 aa, Artificial Sequence
  Synthetic
  MISC_FEATURE (436)..(446): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 25 - protein, 408 aa, Artificial Sequence; identical to SEQ ID NO: 3
  Synthetic
  MISC_FEATURE (204)..(205): optional any amino acid

SEQ ID NO: 26 - protein, 451 aa, Artificial Sequence; identical to SEQ ID NO: 11
  Synthetic
  MISC_FEATURE (1)..(32): optionally absent
  MISC_FEATURE (236)..(237): optional any amino acid
  MISC_FEATURE (441)..(451): optionally absent

SEQ ID NO: 27 - protein, 412 aa, Artificial Sequence; identical to SEQ ID NO: 7
  Synthetic
  MISC_FEATURE (208)..(209): optional any amino acid

SEQ ID NO: 28 - protein, 423 aa, Artificial Sequence; identical to SEQ ID NO: 12
  Synthetic
  MISC_FEATURE (208)..(209): optional any amino acid
  MISC_FEATURE (413)..(423): optionally absent

SEQ ID NO: 29 - protein, 1468 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 30 - protein, 1511 aa, Artificial Sequence
  Synthetic
  MISC_FEATURE (1)..(32): optionally absent
  MISC_FEATURE (1501)..(1511): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 31 - protein, 1472 aa, Artificial Sequence
  Synthetic
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 32 - protein, 1483 aa, Artificial Sequence
  Synthetic
  MISC_FEATURE (1473)..(1483): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 33 - protein, 1445 aa, Artificial Sequence
  Synthetic
  MISC_FEATURE (1241)..(1242): optional any amino acid
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 34 - protein, 1488 aa, Artificial Sequence
  Synthetic
  MISC_FEATURE (1)..(32): optionally absent
  MISC_FEATURE (1273)..(1274): optional any amino acid
  MISC_FEATURE (1479)..(1489): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 35 - protein, 1449 aa, Artificial Sequence
  Synthetic
  MISC_FEATURE (1245)..(1246): optional any amino acid
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 36 - protein, 1460 aa, Artificial Sequence
  Synthetic
  MISC_FEATURE (1245)..(1246): optional any amino acid
  MISC_FEATURE (1450)..(1460): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 37 - protein, 1425 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 38 - protein, 1468 aa, Artificial Sequence
  Synthetic
  MISC_FEATURE (1)..(32): optionally absent
  MISC_FEATURE (1458)..(1468): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 39 - protein, 1429 aa, Artificial Sequence
  Synthetic
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 40 - protein, 1440 aa, Artificial Sequence
  Synthetic
  MISC_FEATURE (1430)..(1440): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 41 - protein, 1402 aa, Artificial Sequence
  Synthetic
  MISC_FEATURE (1198)..(1199): optional any amino acid
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 42 - protein, 1445 aa, Artificial Sequence
  Synthetic
  MISC_FEATURE (1)..(32): optionally absent
  MISC_FEATURE (1230)..(1231): optional any amino acid
  MISC_FEATURE (1435)..(1445): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 43 - protein, 1406 aa, Artificial Sequence
  Synthetic
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 44 - protein, 1417 aa, Artificial Sequence
  Synthetic
  MISC_FEATURE (1407)..(1417): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 45 - protein, 426 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 46 - protein, 469 aa, Artificial Sequence
  Synthetic
  MISC_FEATURE (1)..(32): optionally absent
  MISC_FEATURE (459)..(469): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 47 - protein, 430 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 48 - protein, 441 aa, Artificial Sequence
  Synthetic
  MISC_FEATURE (431)..(441): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 49 - protein, 407 aa, Artificial Sequence
  Synthetic
  MISC_FEATURE (204)..(205): optional any amino acid
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 50 - protein, 450 aa, Artificial Sequence
  Synthetic
  MISC_FEATURE (1)..(32): optionally absent
  MISC_FEATURE (236)..(237): optional any amino acid
  MISC_FEATURE (440)..(450): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 51 - protein, 411 aa, Artificial Sequence
  Synthetic
  MISC_FEATURE (208)..(209): optional any amino acid
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 52 - protein, 422 aa, Artificial Sequence
  Synthetic
  MISC_FEATURE (208)..(209): optional any amino acid
  MISC_FEATURE (412)..(422): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 53 - protein, 430 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 54 - protein, 473 aa, Artificial Sequence
  Synthetic
  MISC_FEATURE (1)..(32): optionally absent
  MISC_FEATURE (463)..(473): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 55 - protein, 434 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 56 - protein, 445 aa, Artificial Sequence
  Synthetic
  MISC_FEATURE (435)..(445): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 57 - protein, 407 aa, Artificial Sequence; identical to SEQ ID NO: 49
  Synthetic
  MISC_FEATURE (204)..(205): optional any amino acid

SEQ ID NO: 58 - protein, 450 aa, Artificial Sequence; identical to SEQ ID NO: 50
  Synthetic
  MISC_FEATURE (1)..(32): optionally absent
  MISC_FEATURE (236)..(237): optional any amino acid
  MISC_FEATURE (440)..(450): optionally absent

SEQ ID NO: 59 - protein, 411 aa, Artificial Sequence; identical to SEQ ID NO: 51
  Synthetic
  MISC_FEATURE (208)..(209): optional any amino acid

SEQ ID NO: 60 - protein, 422 aa, Artificial Sequence; identical to SEQ ID NO: 52
  Synthetic
  MISC_FEATURE (208)..(209): optional any amino acid
  MISC_FEATURE (412)..(422): optionally absent

SEQ ID NO: 61 - protein, 434 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 62 - protein, 477 aa, Artificial Sequence
  Synthetic
  MISC_FEATURE (1)..(32): optionally absent
  MISC_FEATURE (467)..(477): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 63 - protein, 438 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 64 - protein, 449 aa, Artificial Sequence
  Synthetic
  MISC_FEATURE (439)..(449): optionally absent
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 65 - protein, 407 aa, Artificial Sequence; identical to SEQ ID NO: 49
  Synthetic
  MISC_FEATURE (204)..(205): optional any amino acid

SEQ ID NO: 66 - protein, 450 aa, Artificial Sequence; identical to SEQ ID NO: 50
  Synthetic
  MISC_FEATURE (1)..(32): optionally absent
  MISC_FEATURE (236)..(237): optional any amino acid
  MISC_FEATURE (440)..(450): optionally absent

SEQ ID NO: 67 - protein, 411 aa, Artificial Sequence; identical to SEQ ID NO: 51
  Synthetic
  MISC_FEATURE (208)..(209): optional any amino acid

SEQ ID NO: 68 - protein, 422 aa, Artificial Sequence; identical to SEQ ID NO: 52
  Synthetic
  MISC_FEATURE (208)..(209): optional any amino acid
  MISC_FEATURE (412)..(422): optionally absent

SEQ ID NO: 69 - protein, 1467 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 70 - protein, 1510 aa, Artificial Sequence
  Synthetic
  MISC_FEATURE (1)..(32): optionally absent
  MISC_FEATURE (1500)..(1510): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 71 - protein, 1471 aa, Artificial Sequence
  Synthetic
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 72 - protein, 1482 aa, Artificial Sequence
  Synthetic
  MISC_FEATURE (1472)..(1482): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 73 - protein, 1444 aa, Artificial Sequence
  Synthetic
  MISC_FEATURE (1241)..(1242): optional any amino acid
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 74 - protein, 1487 aa, Artificial Sequence
  Synthetic
  MISC_FEATURE (1)..(32): optionally absent
  MISC_FEATURE (1273)..(1274): optional any amino acid
  MISC_FEATURE (1477)..(1487): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 75 - protein, 1448 aa, Artificial Sequence
  Synthetic
  MISC_FEATURE (1245)..(1246): optional any amino acid
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 76 - protein, 1459 aa, Artificial Sequence
  Synthetic
  MISC_FEATURE (1245)..(1246): optional any amino acid
  MISC_FEATURE (1449)..(1459): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 77 - protein, 1425 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 78 - protein, 1468 aa, Artificial Sequence
  Synthetic
  MISC_FEATURE (1)..(32): optionally absent
  MISC_FEATURE (1458)..(1468): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 79 - protein, 1429 aa, Artificial Sequence
  Synthetic
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 80 - protein, 1440 aa, Artificial Sequence
  Synthetic
  MISC_FEATURE (1430)..(1440): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 81 - protein, 1401 aa, Artificial Sequence
  Synthetic
  MISC_FEATURE (1198)..(1199): optional any amino acid
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 82 - protein, 1444 aa, Artificial Sequence
  Synthetic
  MISC_FEATURE (1)..(32): optionally absent
  MISC_FEATURE (1230)..(1231): optional any amino acid
  MISC_FEATURE (1434)..(1444): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 83 - protein, 1405 aa, Artificial Sequence
  Synthetic
  MISC_FEATURE (1202)..(1203): optional any amino acid
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 84 - protein, 1416 aa, Artificial Sequence
  Synthetic
  MISC_FEATURE (1202)..(1203): optional any amino acid
  MISC_FEATURE (1406)..(1416): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 85 - protein, 232 aa, Artificial Sequence
  Synthetic
  MISC_FEATURE (1)..(1): X is at least one second protein comprises an immunogenic portion of a SARS-CoV-2 antigen or a variant or homolog thereof
XGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 86 - protein, 205 aa, Artificial Sequence
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
XKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 87 - protein, 243 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (233)..(243): optionally absent
XGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 88 - protein, 216 aa, Artificial Sequence
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (206)..(216): optionally absent
XKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 89 - protein, 224 aa, Artificial Sequence
  Synthetic
  MISC_FEATURE (1)..(1): X is at least one second protein comprises an immunogenic portion of a SARS-CoV-2 antigen or a variant or homolog thereof
XGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 90 - protein, 205 aa, Artificial Sequence; identical to SEQ ID NO: 86
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 91 - protein, 235 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (225)..(235): optionally absent
XGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 92 - protein, 216 aa, Artificial Sequence; identical to SEQ ID NO: 88
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (206)..(216): optionally absent

SEQ ID NO: 93 - protein, 228 aa, Artificial Sequence
  Synthetic
  MISC_FEATURE (1)..(1): X is at least one second protein comprises an immunogenic portion of a SARS-CoV-2 antigen or a variant or homolog thereof
XGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 94 - protein, 205 aa, Artificial Sequence; identical to SEQ ID NO: 86
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 95 - protein, 239 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (229)..(239): optionally absent
XGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 96 - protein, 216 aa, Artificial Sequence; identical to SEQ ID NO: 88
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (206)..(216): optionally absent

SEQ ID NO: 97 - protein, 271 aa, Artificial Sequence
  Synthetic
  MISC_FEATURE (1)..(1): X is at least one second protein comprises an immunogenic portion of a SARS-CoV-2 antigen or a variant or homolog thereof
XGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATE

SEQ ID NO: 98 - protein, 205 aa, Artificial Sequence; identical to SEQ ID NO: 86
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 99 - protein, 282 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (272)..(282): optionally absent
XGSGRENLYFQGGGGSGYIPEAPRDGQAYVRKDGEWVLLSTFLGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 100 - protein, 216 aa, Artificial Sequence; identical to SEQ ID NO: 88
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (206)..(216): optionally absent

SEQ ID NO: 101 - protein, 228 aa, Artificial Sequence; identical to SEQ ID NO: 93
  Synthetic
  MISC_FEATURE (1)..(1): X is at least one second protein comprises an immunogenic portion of a SARS-CoV-2 antigen or a variant or homolog thereof

SEQ ID NO: 102 - protein, 205 aa, Artificial Sequence; identical to SEQ ID NO: 86
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 103 - protein, 239 aa, Artificial Sequence; identical to SEQ ID NO: 95
  Synthetic
  MISC_FEATURE (1)..(1): X is at least one second protein comprises an immunogenic portion of a SARS-CoV-2 antigen or a variant or homolog thereof
  MISC_FEATURE (229)..(239): optionally absent

SEQ ID NO: 104 - protein, 217 aa, Artificial Sequence
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (207)..(217): optionally absent
XRKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 105 - protein, 223 aa, Artificial Sequence
  Synthetic
  MISC_FEATURE (1)..(1): X is at least one second protein comprises an immunogenic portion of a SARS-CoV-2 antigen or a variant or homolog thereof
XGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 106 - protein, 204 aa, Artificial Sequence
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
XMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 107 - protein, 234 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (224)..(234): optionally absent
XGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 108 - protein, 215 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (2)..(2): X is absent or any amino acid
  MISC_FEATURE (205)..(215): optionally absent
XMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 109 - protein, 227 aa, Artificial Sequence
  Synthetic
  MISC_FEATURE (1)..(1): X is at least one second protein comprises an immunogenic portion of a SARS-CoV-2 antigen or a variant or homolog thereof
XGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 110 - protein, 204 aa, Artificial Sequence; identical to SEQ ID NO: 106
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 111 - protein, 238 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (228)..(238): optionally absent
XGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 112 - protein, 215 aa, Artificial Sequence; identical to SEQ ID NO: 108
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (205)..(215): optionally absent

SEQ ID NO: 113 - protein, 231 aa, Artificial Sequence
  Synthetic
  MISC_FEATURE (1)..(1): X is at least one second protein comprises an immunogenic portion of a SARS-CoV-2 antigen or a variant or homolog thereof
XGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 114 - protein, 204 aa, Artificial Sequence; identical to SEQ ID NO: 106
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 115 - protein, 242 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (232)..(242): optionally absent
XGGSGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 116 - protein, 215 aa, Artificial Sequence; identical to SEQ ID NO: 108
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (205)..(215): optionally absent

SEQ ID NO: 117 - protein, 270 aa, Artificial Sequence
  Synthetic
  MISC_FEATURE (1)..(1): X is at least one second protein comprises an immunogenic portion of a SARS-CoV-2 antigen or a variant or homolog thereof
XGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATE

SEQ ID NO: 118 - protein, 204 aa, Artificial Sequence; identical to SEQ ID NO: 106
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 119 - protein, 281 aa, Artificial Sequence
  Synthetic
  MISC_FEATURE (1)..(1): X is at least one second protein comprises an immunogenic portion of a SARS-CoV-2 antigen or a variant or homolog thereof
  MISC_FEATURE (271)..(281): optionally absent
XGSGRENLYFQGGGGSGYIPEAPRDGQAYVRKDGEWVLLSTFLGGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 120 - protein, 215 aa, Artificial Sequence; identical to SEQ ID NO: 108
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (205)..(215): optionally absent

SEQ ID NO: 121 - protein, 227 aa, Artificial Sequence; identical to SEQ ID NO: 109
  Synthetic
  MISC_FEATURE (1)..(1): X is at least one second protein comprises an immunogenic portion of a SARS-CoV-2 antigen or a variant or homolog thereof

SEQ ID NO: 122 - protein, 204 aa, Artificial Sequence; identical to SEQ ID NO: 106
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof

SEQ ID NO: 123 - protein, 238 aa, Artificial Sequence; identical to SEQ ID NO: 111
  Synthetic
  MISC_FEATURE (1)..(1): X is at least one second protein comprises an immunogenic portion of a SARS-CoV-2 antigen or a variant or homolog thereof
  MISC_FEATURE (228)..(238): optionally absent

SEQ ID NO: 124 - protein, 215 aa, Artificial Sequence; identical to SEQ ID NO: 108
  Synthetic
  MISC_FEATURE (1)..(2): optional any amino acid
  MISC_FEATURE (1)..(1): X is at least one second protein comprises an immunogenic portion of a SARS-CoV-2 antigen or a variant or homolog thereof
  MISC_FEATURE (205)..(215): optionally absent

SEQ ID NO: 125 - protein, 204 aa, Artificial Sequence
  Synthetic
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST

SEQ ID NO: 126 - protein, 208 aa, Artificial Sequence
  Synthetic
ETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKST

SEQ ID NO: 127 - protein, 1198 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 128 - protein, 1202 aa, Artificial Sequence
  Synthetic
  MISC_FEATURE (1)..(4): optionally absent
ETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 129 - protein, 1230 aa, Artificial Sequence
  Synthetic
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 130 - protein, 1208 aa, Artificial Sequence
  Synthetic
  MISC_FEATURE (1)..(15): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 131 - protein, 1160 aa, Artificial Sequence
  Synthetic
  MISC_FEATURE (1)..(15): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT

SEQ ID NO: 132 - protein, 1195 aa, Artificial Sequence
  Synthetic
  MISC_FEATURE (1)..(2): optionally absent
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 133 - protein, 1147 aa, Artificial Sequence
  Synthetic
  MISC_FEATURE (1)..(2): optionally absent
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT

SEQ ID NO: 134 - protein, 1193 aa, Artificial Sequence
  Synthetic
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 135 - protein, 1145 aa, Artificial Sequence
  Synthetic
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT

SEQ ID NO: 136 - protein, 1199 aa, Artificial Sequence
  Synthetic
ETCTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 137 - protein, 1151 aa, Artificial Sequence
  Synthetic
ETCTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHT

SEQ ID NO: 138 - protein, 1446 aa, Artificial Sequence
  Synthetic
  MISC_FEATURE (1)..(15): optionally absent
  MISC_FEATURE (1209)..(1231): optionally absent
  MISC_FEATURE (1436)..(1446): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 139 - protein, 1475 aa, Artificial Sequence
  Synthetic
  MISC_FEATURE (1)..(15): optionally absent
  MISC_FEATURE (1209)..(1260): optionally absent
  MISC_FEATURE (1465)..(1475): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGYIPEAPRDGQAYVRKDGEWVLLSTFLGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 140 - protein, 1398 aa, Artificial Sequence
  Synthetic
  MISC_FEATURE (1)..(15): optionally absent
  MISC_FEATURE (1161)..(1183): optionally absent
  MISC_FEATURE (1388)..(1398): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 141 - protein, 1427 aa, Artificial Sequence
  Synthetic
  MISC_FEATURE (1)..(15): optionally absent
  MISC_FEATURE (1161)..(1212): optionally absent
  MISC_FEATURE (1417)..(1427): optionally absent
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTGSGYIPEAPRDGQAYVRKDGEWVLLSTFLGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 142 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 143 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 144 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 145 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 146 - protein, 478 aa, Artificial Sequence
  Synthetic
  MISC_FEATURE (1)..(32): optionally absent
  MISC_FEATURE (237)..(263): optionally absent
  MISC_FEATURE (468)..(478): optionally absent
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 147 - protein, 474 aa, Artificial Sequence
  Synthetic
  MISC_FEATURE (1)..(28): optionally absent
  MISC_FEATURE (233)..(259): optionally absent
  MISC_FEATURE (464)..(474): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 148 - protein, 474 aa, Artificial Sequence
  Synthetic
  MISC_FEATURE (1)..(28): optionally absent
  MISC_FEATURE (233)..(259): optionally absent
  MISC_FEATURE (464)..(474): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 149 - protein, 474 aa, Artificial Sequence
  Synthetic
  MISC_FEATURE (1)..(18): optionally absent
  MISC_FEATURE (233)..(259): optionally absent
  MISC_FEATURE (464)..(474): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 150 - protein, 474 aa, Artificial Sequence
  Synthetic
  MISC_FEATURE (1)..(28): optionally absent
  MISC_FEATURE (233)..(259): optionally absent
  MISC_FEATURE (464)..(474): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 151 - protein, 474 aa, Artificial Sequence
  Synthetic
  MISC_FEATURE (1)..(28): optionally absent
  MISC_FEATURE (233)..(259): optionally absent
  MISC_FEATURE (464)..(474): optionally absent
MGILPSPGMPALLSLVSLLSVLLMGCVARFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTGGSGGSGSGGSGGSGSEKAAKAEEAARKMEELFKKHKIVAVLRANSVEEAIEKAVAVFAGGVHLIEITFTVPDADTVIKALSVLKEKGAIIGAGTVTSVEQARKAVESGAEFIVSPHLDEEISQFAKEKGVFYMPGVMTPTELVKAMKLGHTILKLFPGEVVGPQFVKAMKGPFPNVKFVPTGGVNLDNVAEWFKAGVLAVGVGSALVKGTPDEVREKAKAFVEKIRGATEGGSHHHHHHHH

SEQ ID NO: 152 - protein, 157 aa, Artificial Sequence
  Synthetic
  MISC_FEATURE (1)..(1): optionally absent
MNQHSHKDYETVRIAVVRARWHAEIVDACVSAFEAAMADIGGDRFAVDVFDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAA

SEQ ID NO: 153 - protein, 157 aa, Artificial Sequence
  Synthetic
  MISC_FEATURE (1)..(1): optionally absent
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHRYRDSDAHTLLFLALFAVKGMEAARACVEILAAREKIAA

SEQ ID NO: 154 - protein, 157 aa, Artificial Sequence
  Synthetic
  MISC_FEATURE (1)..(1): optionally absent
MNQHSHKDHETVRIAVVRARWHAEIVDACVSAFEAAMRDIGGDRFAVDVFDVPGAYEIPLHARTLAETGRYGAVLGTAFVVDGGIYDHEFVASAVIDGMMNVQLDTGVPVLSAVLTPHEYEDSDADTLLFLALFAVKGMEAARACVEILAAREKIAA

SEQ ID NO: 155 - protein, 157 aa, Artificial Sequence
  Synthetic
  MISC_FEATURE (1)..(1): optionally absent
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVINGMMNVQLNTGVPVLSAVLTPHNYDKSKAHTLLFLALFAVKGMEAARACVEILAAREKIAA

SEQ ID NO: 156 - protein, 193 aa, Artificial Sequence
  Synthetic
  MISC_FEATURE (1)..(31): optionally absent
  MISC_FEATURE (188)..(193): optionally absent
MGSSHHHHHHSSGLVPRGSEQKLISEEDLGSNQHSQKDQETVRIAVVRARWHAFIVDACVSAFEAAMRKIGGERFAVDVFDVPGAYEIPLHARTLAKTGRYGAVLGTAFVVNGGIYRHEFVASAVIDGMMNVQLDTGVPVLSAVLTPHNYDKSNAKTLLFLALFAVKGMEAARACVEILAAREKIAAGSLEGS

SEQ ID NO: 157 - protein, 159 aa, Artificial Sequence
  Synthetic
  MISC_FEATURE (1)..(1): optionally absent
  MISC_FEATURE (158)..(159): optionally absent
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSKAHTLLFLALFAVKGMEAARACVEILAAREKIAAGS

SEQ ID NO: 158 - protein, 159 aa, Artificial Sequence
  Synthetic
  MISC_FEATURE (1)..(1): optionally absent
  MISC_FEATURE (158)..(159): optionally absent
MNQHSHKDHETVRIAVVRARWHAFIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSNAKTLLFLALFAVKGMEAARACVEILAAREKIAAGS

SEQ ID NO: 159 - protein, 159 aa, Artificial Sequence; identical to SEQ ID NO: 158
  Synthetic
  MISC_FEATURE (1)..(1): optionally absent
  MISC_FEATURE (158)..(159): optionally absent

SEQ ID NO: 160 - protein, 244 aa, Artificial Sequence
  Synthetic
MGILPSPGMPALLSLVSLLSVLLMGCVAETGTRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTHHHHHHHH

SEQ ID NO: 161 - protein, 1281 aa, Artificial Sequence
  Synthetic
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGRENLYFQGGGGSGYIPEAPRDGQAYVRKDGEWVLLSTFLGHHHHHHHH

SEQ ID NO: 162 - protein, 860 aa, Artificial Sequence
  Synthetic
MARAWIFFLLCLAGRALASTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTGTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADPLVPRGSGGGGDPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 993 aa, Artificial Sequence
  Synthetic
MPMGSLQPLATLYLLGMLVASVLAQSTIEEQAKTFLDKFNHEAEDLFYQSSLASWNYNTNITEENVQNMNNAGEKWSAFLKEQSTLAQMYPLQEIQNLTVKLQLQALQQNGSSVLSEDKSKRLNTILNTMSTIYSTGKVCNPNNPQECLLLDPGLNEIMEKSLDYNERLWAWEGWRSEVGKQLRPLYEEYVVLKNEMARANHYKDYGDYWRGNYEVNGVDGYDYNRDQLIEDVERTFEEIKPLYEHLHAYVRAKLMNAYPSYISPTGCLPAHLLGDMWGRFWTNLYSLTVPFGQKPNIDVTDAMVNQAWNAQRIFKEAEKFFVSVGLPNMTQGFWENSMLTDPGNVQKVVCHPTAWDLGKGDFRIIMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLLNMLKLGKSEPWTLALENVVGAKNMNVRPLLNYFEPLFTWLKDQNKNSFVGWSTDWSPYADQSIKVRISLKSALGDKAYEWNDNEMYLFRSSVAYAMRTYFLEIKHQTILFGEEDVRVADLKPRISFNFYVTAPKNVSDIIPRTEVEEAIRISRSRINDAFRLNDNSLEFLGIQTTLAPPYQSPVTDPLVPRGSGGGGDPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 9 aa, Artificial Sequence
  Synthetic
GHHHHHHHH

SEQ ID NO: 165 - protein, 11 aa, Artificial Sequence
  Synthetic
GSGRENLYFQG

SEQ ID NO: 166 - protein, 31 aa, Artificial Sequence
  Synthetic
GGGSGYIPEAPRDGQAYVRKDGEWVLLSTFL

SEQ ID NO: 167 - protein, 408 aa, Artificial Sequence; identical to SEQ ID NO: 3
  Synthetic
  MISC_FEATURE (204)..(205): optional any amino acid

SEQ ID NO: 168 - protein, 474 aa, Artificial Sequence; identical to SEQ ID NO: 22
  Synthetic
  MISC_FEATURE (1)..(32): optionally absent
  MISC_FEATURE (237)..(259): optionally absent
  MISC_FEATURE (464)..(474): optionally absent

SEQ ID NO: 169 - protein, 408 aa, Artificial Sequence; identical to SEQ ID NO: 3
  Synthetic
  MISC_FEATURE (204)..(205): optional any amino acid

SEQ ID NO: 170 - protein, 478 aa, Artificial Sequence; identical to SEQ ID NO: 9
  Synthetic
  MISC_FEATURE (1)..(32): optionally absent
  MISC_FEATURE (237)..(263): optionally absent
  MISC_FEATURE (468)..(478): optionally absent

SEQ ID NO: 171 - protein, 1402 aa, Artificial Sequence; identical to SEQ ID NO: 41
  Synthetic
  MISC_FEATURE (1198)..(1199): optional any amino acid

SEQ ID NO: 172 - protein, 1511 aa, Artificial Sequence; identical to SEQ ID NO: 30
  Synthetic
  MISC_FEATURE (1)..(32): optionally absent
  MISC_FEATURE (1231)..(1296): optionally absent
  MISC_FEATURE (1501)..(1511): optionally absent

SEQ ID NO: 173 - protein, 1402 aa, Artificial Sequence; identical to SEQ ID NO: 41
  Synthetic
  MISC_FEATURE (1198)..(1199): optional any amino acid

SEQ ID NO: 174 - protein, 1468 aa, Artificial Sequence; identical to SEQ ID NO: 38
  Synthetic
  MISC_FEATURE (1)..(32): optionally absent
  MISC_FEATURE (1231)..(1253): optionally absent
  MISC_FEATURE (1458)..(1468): optionally absent

SEQ ID NO: 175 - protein, 407 aa, Artificial Sequence; identical to SEQ ID NO: 49
  Synthetic
  MISC_FEATURE (204)..(205): optional any amino acid

SEQ ID NO: 176 - protein, 469 aa, Artificial Sequence; identical to SEQ ID NO: 46
  Synthetic
  MISC_FEATURE (1)..(32): optionally absent
  MISC_FEATURE (237)..(255): optionally absent
  MISC_FEATURE (459)..(469): optionally absent

SEQ ID NO: 177 - protein, 407 aa, Artificial Sequence; identical to SEQ ID NO: 49
  Synthetic
  MISC_FEATURE (204)..(205): optional any amino acid

SEQ ID NO: 178 - protein, 473 aa, Artificial Sequence; identical to SEQ ID NO: 54
  Synthetic
  MISC_FEATURE (1)..(32): optionally absent
  MISC_FEATURE (237)..(259): optionally absent
  MISC_FEATURE (463)..(473): optionally absent

SEQ ID NO: 179 - protein, 407 aa, Artificial Sequence; identical to SEQ ID NO: 49
  Synthetic
  MISC_FEATURE (204)..(205): optional any amino acid

SEQ ID NO: 180 - protein, 477 aa, Artificial Sequence; identical to SEQ ID NO: 62
  Synthetic
  MISC_FEATURE (1)..(32): optionally absent
  MISC_FEATURE (237)..(263): optionally absent
  MISC_FEATURE (467)..(477): optionally absent

SEQ ID NO: 181 - protein, 1401 aa, Artificial Sequence; identical to SEQ ID NO: 81
  Synthetic
  MISC_FEATURE (1198)..(1199): optional any amino acid

SEQ ID NO: 182 - protein, 1510 aa, Artificial Sequence; identical to SEQ ID NO: 70
  Synthetic
  MISC_FEATURE (1)..(32): optionally absent
  MISC_FEATURE (1231)..(1296): optionally absent
  MISC_FEATURE (1500)..(1510): optionally absent

SEQ ID NO: 183 - protein, 1401 aa, Artificial Sequence; identical to SEQ ID NO: 81
  Synthetic
  MISC_FEATURE (1198)..(1199): optional any amino acid

SEQ ID NO: 184 - protein, 1467 aa, Artificial Sequence
  Synthetic
  MISC_FEATURE (1)..(32): optionally absent
  MISC_FEATURE (1231)..(1253): optionally absent
  MISC_FEATURE (1457)..(1467): optionally absent
MGILPSPGMPALLSLVSLLSVLLMGCVAETGTQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSGAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGSGSGGSGGSGSEKAAKAEEAARMEELFKEHKIVAVLRANSVEEAKKKALAVFLGGVDLIEITFTVPDADTVIKELSFLKEMGAIIGAGTVTSVEQAREAVESGAEFIVSPHLDEEISQFAKEEGVFYMPGVMTPTELVKAMKLGHTILKLFPGEVVGPQFVEAMKGPFPNVKFVPTGGVNLDNVAEWFEAGVQAVGVGEALNEGTPVEVAEKAKAFVEKIEGATEGGSHHHHHHHH

SEQ ID NO: 185 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARENAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFNLEGSEQKLISEEDLHHHHHH

SEQ ID NO: 186 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARWNAEIILALVLGANKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFNLEGSEQKLISEEDLHHHHHH

SEQ ID NO: 187 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLNCDKDEQAEARAGLIEGKMHNHGEDWGAAAVEMATKFNLEGSEQKLISEEDLHHHHHH

SEQ ID NO: 188 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLNCLTDEQAEARAGLIEGKMHNHGEDWGAAAVEMATKFNLEGSEQKLISEEDLHHHHHH

SEQ ID NO: 189 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCDTDEQAEARAGLIEGKMHNHGEDWGAAAVEMATKFNLEGSEQKLISEEDLHHHHHH

SEQ ID NO: 190 - protein, 199 aa, Artificial Sequence
  Synthetic
  MISC_FEATURE (1)..(25): optionally absent
  MISC_FEATURE (180)..(199): optionally absent
METDTLLLWVLLLWVPGSTGDYKDEKKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLKDEQAEARAGLIEGKMHNHGEDWGAAAVEMATKFNLEGSEQKLISEEDLHHHHHH

SEQ ID NO: 191 - protein, 200 aa, Artificial Sequence
  Synthetic
  MISC_FEATURE (1)..(27): optionally absent
  MISC_FEATURE (181)..(200): optionally absent
METDTLLLWVLLLWVPGSTGDYKDEMGKYDGSKLRIGILHARGNAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFNLEGSEQKLISEEDLHHHHHH

SEQ ID NO: 192 - protein, 200 aa, Artificial Sequence
  Synthetic
  MISC_FEATURE (1)..(27): optionally absent
  MISC_FEATURE (181)..(200): optionally absent
METDTLLLWVLLLWVPGSTGDYKDEMGKYDGSKLRIGILHARENAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFNLEGSEQKLISEEDLHHHHHH

SEQ ID NO: 193 - protein, 197 aa, Artificial Sequence
  Synthetic
  MISC_FEATURE (1)..(27): optionally absent
  MISC_FEATURE (178)..(197): optionally absent
METDTLLLWVLLLWVPGSTGDYKDEMGKYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFNLEGSEQKLISEEDLHHHHHH

We claim:

1. A polypeptide comprising an amino acid sequence selected from the group consisting of SEQ ID NOS: 1, 2, 5, 6, 8-10,13-16, 21-24, 142-151, 168 and 170.

2. A nanoparticle, comprising:

(a) a plurality of first assemblies, each first assembly comprising a plurality of identical first proteins comprising the amino acid sequence selected the group consisting of SEQ ID NOS: 152-159; and, (b) a plurality of second assemblies, each second assembly comprising a plurality of second proteins;

wherein the amino acid sequence of the first protein differs from the sequence of the second protein;

wherein the plurality of first assemblies non-covalently interact with the plurality of second assemblies to form the nanoparticle;

wherein the nanoparticle displays on its surface an immunogenic portion of a severe acute respiratory syndrome coronavirus type 2 (SARS-COV-2) antigen present in at least one second protein, and wherein the second proteins comprise an amino acid sequence selected from the group consisting of SEQ ID NOS: 1, 2, 5, 6, 8-10,13-16, 21-24, 142-151, 168, and 170.

3. The nanoparticle of claim 2, wherein (a) the plurality of second assemblies in total comprise 2, 3, 4, 5, 6, 7, 8, or more different SARS-COV-2 antigens;

(b) the plurality of second assemblies in total comprise 2, 3, 4, 5, 6, 7, 8, or more polypeptides comprising the amino acid sequence selected from the group consisting of SEQ ID NOS: 1, 2, 5, 6, 8-10,13-16, 21-24, 142-151, 168, and 170;

(c) all second assemblies comprise at least one second protein comprising the amino acid sequence of a polypeptide comprising an amino acid selected from the group consisting of SEQ ID NOS: 1, 2, 5, 6, 8-10, 13-16, 21-24, 142-151, 168, and 170; and/or (d) all second proteins comprise the amino acid sequence of a polypeptide comprising an amino acid sequence selected from the group consisting of SEQ ID NOS: 1, 2, 5, 6, 8-10,13-16, 21-24, 142-151, 168, and 170.

4. The nanoparticle of claim 2, wherein the first proteins comprise the amino acid sequence selected the group consisting of SEQ ID NOS: 152-159.

(b) at least 20% of the second proteins comprise an amino acid sequence that is at least 95% identical to the amino acid sequence of SEQ ID NO:1.

8. The nanoparticle of claim 2 wherein:

(a) the first proteins comprise the amino acid sequence of SEQ ID NO:155;

(b) all second proteins comprise an amino acid sequence selected from the group consisting of SEQ ID NO: 1, 2, 5, 6, or 8.

9. A pharmaceutical composition comprising (a) the nanoparticle of claim 2; and (b) a pharmaceutically acceptable carrier.

10. The pharmaceutical composition of claim 9, further comprising an adjuvant.

11. A vaccine comprising the nanoparticle of claim 2.

12. A method to treat or limit development of a SARS-COV-2 infection, comprising administering to a subject in need thereof an amount effective to treat or limit development of the infection the pharmaceutical composition of claim 9.

13. The method of claim 12, wherein the subject is not infected with SARS-COV-2 and the administering elicits an immune response against SARS-COV-2 in the subject that limits development of a SARS-COV-2 infection in the subject.

14. The method of claim 13, wherein the administering comprises administering a first dose and a second dose, wherein the second dose is administered about 2 weeks to about 12 weeks after the first dose is administered, or about 4 weeks to about 12 weeks after the first dose is administered.

15. The method of claim 13, wherein the immune response comprises generation of neutralizing antibodies against SARS-COV-2.

16. The method of claim 13, wherein the immune response comprises generation of SARS-COV-2 spike protein antibody-specific responses with a mean geometric titer of at least $1\times10^5$.

17. The method of claim 12, wherein the subject is infected with SARS-COV-2 and the administering elicits an immune response against SARS-COV-2 in the subject that treats a SARS-COV-2 infection in the subject.

18. A kit, comprising:

(a) a polypeptide comprising an amino acid sequence selected from the group consisting of SEQ ID NOS: 1, 2, 5, 6, 8-10,13-16, 21-24, 142-151, 168, and 170; and (b) a first protein comprising an amino acid sequence selected the group consisting of SEQ ID NOS: 152-159.

19. The kit of claim 18, wherein the first protein comprises the amino acid sequence of SEQ ID NO:155.

* * * * *